(12) United States Patent
Kim et al.

(10) Patent No.: US 12,043,827 B2
(45) Date of Patent: Jul. 23, 2024

(54) COMPOSITIONS, SYSTEMS, AND METHODS FOR BASE DIVERSIFICATION

(71) Applicant: Pairwise Plants Services, Inc., Durham, NC (US)

(72) Inventors: Yongjoo Kim, Durham, NC (US); Aaron Hummel, Hillsborough, NC (US)

(73) Assignee: Pairwise Plants Services, Inc., Durham, NC (US)

( * ) Notice: Subject to any disclaimer, the term of this patent is extended or adjusted under 35 U.S.C. 154(b) by 291 days.

(21) Appl. No.: 17/363,546

(22) Filed: Jun. 30, 2021

(65) Prior Publication Data

US 2021/0403898 A1 Dec. 30, 2021

Related U.S. Application Data

(60) Provisional application No. 63/046,235, filed on Jun. 30, 2020.

(51) Int. Cl.
| | |
|---|---|
| *C12N 15/10* | (2006.01) |
| *C12N 15/11* | (2006.01) |
| *C12N 15/63* | (2006.01) |
| *C12N 15/85* | (2006.01) |

(52) U.S. Cl.
CPC .......... *C12N 15/102* (2013.01); *C12N 15/11* (2013.01); *C12N 15/63* (2013.01); *C12N 15/85* (2013.01); *C12N 2310/20* (2017.05)

(58) Field of Classification Search
None
See application file for complete search history.

(56) References Cited

U.S. PATENT DOCUMENTS

| | | |
|---|---|---|
| 5,459,252 A | 10/1995 | Conkling et al. |
| 5,604,121 A | 2/1997 | Hilder et al. |
| 5,625,136 A | 4/1997 | Koziel et al. |
| 5,641,876 A | 6/1997 | McElroy et al. |
| 6,040,504 A | 3/2000 | Rice et al. |
| 7,141,424 B2 | 11/2006 | Shin et al. |
| 7,166,770 B2 | 1/2007 | Hohn et al. |
| 7,579,516 B2 | 8/2009 | Boudreau |
| 9,790,490 B2 | 10/2017 | Zhang et al. |
| 9,982,053 B2 | 5/2018 | Pantaleo et al. |
| 10,113,163 B2 | 10/2018 | Liu et al. |
| 10,167,457 B2 | 1/2019 | Liu et al. |
| 10,421,972 B2 | 9/2019 | Lira et al. |
| 2016/0319262 A1 | 11/2016 | Doudna et al. |
| 2017/0219596 A1 | 8/2017 | Tanenbaum et al. |
| 2019/0330698 A1 | 10/2019 | Khera et al. |
| 2020/0332307 A1 | 10/2020 | Hummel et al. |
| 2021/0238598 A1 | 8/2021 | Kim et al. |

FOREIGN PATENT DOCUMENTS

| | | | |
|---|---|---|---|
| CN | 109517841 A | 3/2019 | |
| EP | 0255378 A2 | 2/1988 | |
| EP | 0342926 A2 | 11/1989 | |
| EP | 0452269 A2 | 10/1991 | |
| WO | 9307278 A1 | 4/1993 | |
| WO | 9942587 A1 | 8/1999 | |
| WO | 0173087 A1 | 10/2001 | |
| WO | 2018136783 A1 | 7/2018 | |
| WO | 2018165629 A1 | 9/2018 | |
| WO | 2019079347 A1 | 4/2019 | |
| WO | WO-2019079347 A1 * | 4/2019 | ......... A61K 31/7088 |
| WO | 2020028823 A1 | 2/2020 | |
| WO | 2020041249 A1 | 2/2020 | |
| WO | 2020089489 A1 | 5/2020 | |
| WO | 2020181195 A1 | 9/2020 | |
| WO | WO-2020181195 A1 * | 9/2020 | |

OTHER PUBLICATIONS

Samson et al. PNAS 88:9127-9131, 1991 (Year: 1991).*
Hess et al. "Directed evolution using dCas9-targeted somatic hypermutation in mammalian cells" Nature Methods, 13 (12):1036-1042 (2016).
Hua et al. "Expanding the base editing scope in rice by using Cas9 variants" Plant Biotechnology Journal, 17:499-504 (2019).
Kunii et al. "Three-Component Repurposed Technology for Enhanced Expression: Highly Accumulable Transcriptional Activators via Branched Tag Arrays" The CRISPR Journal, 1(5):337-347 (2018).
Li et al. "Targeted, random mutagenesis of plant genes with dual cytosine and adenine base editors" Nature Biotechnology, 38:875-882 (2020).
Liu et al. "Efficient generation of mouse models of human diseases via ABE- and BE-mediated base editing" Nature Communications, 9(1):1-8 & supplementary information (2018).
Liu et al. "Intrinsic Nucleotide Preference of Diversifying Base Editors Guides Antibody Ex Vivo Affinity Maturation" Cell Reports, 25:884-892 (2018).
Rees et al. "Base editing: precision chemistry on the genome and transcriptome of living cells" Nature Reviews Genetics, 19(12):770-788 (2018).
Sakata et al. "A single CRISPR base editor to induce simultaneous C-to-T and A-to-G mutations" bioRxiv, pp. 1-17 (2019).
International Search Report and the Written Opinion of the International Searching Authority corresponding to International Patent Application No. PCT/US2021/039817 (14 pages) (mailed Nov. 5, 2021).
Komor et al. "Programmable editing of a target base in genomic DNA without double-stranded DNA cleavage" Nature, 533(7603):420-424 (2016).
Krokan et al. "Base Excision Repair" Cold Spring Harbor Perspectives in Biology, 5(4):a012583 (2013).
Kurt et al. "CRISPR C-to-G base editors for inducing targeted DNA transversions in human cells" Nature Biotechnology, 39(1):41-46 (2021).

(Continued)

*Primary Examiner* — Marcia S Noble
(74) *Attorney, Agent, or Firm* — Myers Bigel, P.A.

(57) ABSTRACT

Described herein are methods of modifying or editing a target nucleic acid such as methods that edit adenine to cytosine, thymine, or guanine. Compositions and systems for modifying or editing a target nucleic acid are also described. Methods, compositions and systems described herein may be used for generating allelic diversity.

18 Claims, 19 Drawing Sheets

Specification includes a Sequence Listing.

(56) References Cited

OTHER PUBLICATIONS

Zhao et al. "Glycosylase base editors enable C-to-A and C-to-G base changes" Nature Biotechnology, 39(1):35-40 (2021).
Chen et al. "The expression of APE1 in triple-negative breast cancer and its effect on drug sensitivity of olaparib" Tumor Biology, 39(10):1-9 (2017).
Hu et al. "Ligase IV inhibitor SCR7 enhances gene editing directed by CRISPR-Cas9 and ssODN in human cancer cells" Cell & Bioscience, 8(12):1-15 (2018).
Nishida et al. "Targeted nucleotide editing using hybrid prokaryotic and vertebrate adaptive immune systems" Science, 353(6305):aaf8729 (2016).
Zhong et al. "Precise base editing in rice, wheat and maize with a Cas9-cytidine deaminase fusion" Nature Biotechnology, 35(5):438-440 (2017).
Al-Safi et al. "Small-molecule inhibitors of APE1 DNA repair function: an overview" Current Molecular Pharmacology, 5:14-35 (2012).
Alseth et al. "Biochemical characterization and DNA repair pathway interactions of Mag1-mediated base excision repair in *Schizosaccharomyces pombe*" Nucleic Acids Research, 33(3):1123-1131 (2005).
Barrangou, Rodolphe "Diversity of CRISPR-Cas immune systems and molecular machines" Genome Biology, 16 (247):1-11 (2015).
Berjon-Otero et al. "DNA polymerase from temperate phage Bam35 is endowed with processive polymerization and abasic sites translesion synthesis capacity" Proceedings of the National Academy of Sciences, 112(27): E3476-3484 (2015).
Chen et al. "Rational Design of Human DNA Ligase Inhibitors that Target Cellular DNA Replication and Repair" Cancer Research, 68(9):3169-3177 (2008).
Deveau et al. "Phage Response to CRISPR-Encoded Resistance in *Streptococcus thermophilus*" Journal of Bacteriology, 190(4):1390-1400 (2008).
Esvelt et al. "Orthogonal Cas9 Proteins for RNA-Guided Gene Regulation and Editing" Nature Methods, 10 (11):1116-1121 (2013).
Garcia-Gomez et al. "PrimPol, an archaic primase/polymerase operating in human cells" Molecular Cell, 52:541-553 (2013).
Gaudelli et al. "Directed evolution of adenine base editors with increased activity and therapeutic application" Nature Biotechnology, 38(7):892-900 (2020).
Gaudelli et al. "Programmable base editing of A•T to G•C in genomic DNA without DNA cleavage" Nature, 551 (7681):464-471 (2017).
Gilbreth et al. "Structural Insights for Engineering Binding Proteins Based on Non-Antibody Scaffolds" Current Opinion in Structural Biology, 22(4):413-420 (2012).
Grissa et al. "CRISPRFinder: a web tool to identify clustered regularly interspaced short palindromic repeats" Nucleic Acids Research, 35:W52-W57 (2007).
Halperin et al. "CRISPR-guided DNA polymerases enable diversification of all nucleotides in a tunable window" Nature, 560:248-252 (2018).
Hou et al. "Efficient genome engineering in human pluripotent stem cells using Cas9 from Neisseria meningitidis" Proceedings of the National Academy of Sciences, 110(39):15644-15649 (2013).
Jiang et al. "CRISPR-assisted editing of bacterial genomes" Nature Biotechnology, 31(3):233-239 (2013).
Kim et al. "CRISPR/Cpf1-mediated DNA-free plant genome editing" Nature Communications, 8:14406 (2017).
Komor et al. "Improved base excision repair inhibition and bacteriophage Mu Gam protein yields C:G-to-T:A base editors with higher efficiency and product purity" Science Advances, 3(8):eaao4774, pp. 1-9 (2017).
Kostyushev et al. "Suppressing the NHEJ pathway by DNA-PKcs inhibitor NU7026 prevents degradation of HBV cccDNA cleaved by CRISPR/Cas9" Scientific Reports, 9(1):1847 (2019).
Lee et al. "New Family of Deamination Repair Enzymes in Uracil-DNA Glycosylase Superfamily" The Journal of Biological Chemistry, 286(36):31282-31287 (2011).
Lee et al. "Recognition and Processing of a New Repertoire of DNA Substrates by Human 3-Methyladenine DNA Glycosylase (AAG)" Biochemistry, 48(9):1850-1861 (2009).
Liang et al. "Efficient DNA-free genome editing of bread wheat using CRISPR/Cas9 ribonucleoprotein complexes" Nature Communications, 8:14261 (2017).
Ma et al. "Targeted AID-mediated mutagenesis (TAM) enables efficient genomic diversification in mammalian cells" Nature Methods, 13(12):1029-1035 (2016).
Mali et al. "Cas9 as a versatile tool for engineering biology" Nature Methods, 10(10):957-963 (2013).
Mali et al. "RNA-Guided Human Genome Engineering via Cas9" Science, 339(6121):823-826 (2013).
Malnoy et al. "DNA-Free Genetically Edited Grapevine and Apple Protoplast Using CRISPR/Cas9 Ribonucleoproteins" Frontiers in Plant Science, 7(1904):1-9 (2016).
Maruyama et al. "Increasing the efficiency of precise genome editing with CRISPR-Cas9 by inhibition of nonhomologous end joining" Nature Biotechnology, 33(5):538-542 (2015).
Neal et al. "Inhibition of homologous recombination by DNA-dependent protein kinase requires kinase activity, is itratable, and is modulated by autophosphorylation" Molecular and Cellular Biology, 31(8):1719-1733 (2011).
Pastor-Palacios et al. "A Transposon-Derived DNA Polymerase from Entamoeba histolytica Displays Intrinsic Strand Displacement, Processivity and Lesion Bypass" PLOS One, 7(11):e49964 (2012).
Ran et al. "Genome engineering using the CRISPR-Cas9 system" Nature Protocols, 8(11):2281-2308 (2013).
Richter et al. "Phage-assisted evolution of an adenine base editor with improved Cas domain compatibility and activity" Nature Biotechnology, 38(7):883-891 (2020).
Robert et al. "Pharmacological inhibition of DNA-PK stimulates Cas9-mediated genome editing" Genome Medicine, 7:93, pp. 1-11 (2015).
Rodriguez-Leal et al. "Engineering Quantitative Trait Variation for Crop Improvement by Genome Editing" Cell, 171:470-480 (2017).
Sakata et al. "A single CRISPR base editor to induce simultaneous C-to-T and A-to-G mutations" bioRxiv, 729269, pp. 1-17 (2019).
Sha et al. "Monobodies and other synthetic binding proteins for expanding protein science" Protein Science, 26:910-924 (2017).
Shee et al. "Engineered proteins detect spontaneous DNA breakage in human and bacterial cells" eLife, 2:e01222 (2013).
Svitashev et al. "Genome editing in maize directed by CRISPR-Cas9 ribonucleoprotein complexes" Nature Communications, 7:13274 (2016).
Tak et al. "Inducible and multiplex gene regulation using CRISPR-Cpf1-based transcription factors" Nature Methods, 14(12):1163-1166 (2017).
Thuronyi et al. "Continuous evolution of base editors with expanded target compatibility and improved activity" Nature Biotechnology, 37(9):1070-1079 (2019).
Vartak et al. "Inhibition of nonhomologous end joining to increase the specificity of CRISPR/Cas9 genome editing" the FEBS Journal, 282(22):4289-4294 (2015).
Vob et al. "Chemically induced dimerization: reversible and spatiotemporal control of protein function in cells" Current Opinion in Chemical Biology, 28:194-201 (2015).
Wang et al. "Efficient base editing in methylated regions with a human APOBEC 3A-Cas9 fusion" Nature Biotechnology, 36(10):946-949 (2018).
Woo et al. "DNA-free genome editing in plants with preassembled CRISPR-Cas9 ribonucleoproteins" Nature Biotechnology, 33(11):1162-1164 (2015).
Zhang et al. "Efficient and transgene-free genome editing in wheat through transient expression of CRISPR/Cas9 DNA or RNA" Nature Communications, 7:12617 (2016).
Fujita et al. "Applications of Engineered DNA-Binding Molecules Such as TAL Proteins and the CRISPR/Cas System in Biology Research" International Journal of Molecular Sciences, 16:23143-23164 (2015).
Kuluev et al. "Delivery of CRISPR/Cas Components into Higher Plant Cells for Genome Editing" Russian Journal of Plant Physiology, 66(5):694-706 (2019).

(56) References Cited

OTHER PUBLICATIONS

Li et al. "Base editing with a Cpf1-cytidine deaminase fusion" Nature Biotechnology, 36(4):324-327 (2018).
Pearl, Laurence H. "Structure and function in the uracil-DNA glycosylase superfamily" Mutation Research, 460:165-181 (2000).
Rai et al. "Synthesis, Biological Evolution, and Structure-Activity Relationships of a Novel Class of Apurinic/Apyrimidinic Endonuclease 1 Inhibitors" Journal of Medicinal Chemistry, 55:3101-3112 (2012).
Huang et al. "DNA epigenome editing using CRISPR-Cas SunTag-directed DNMT3A" Genome Biology 18:175 (2017).

* cited by examiner

COMPOSITIONS, SYSTEMS, AND METHODS FOR BASE DIVERSIFICATION

STATEMENT REGARDING ELECTRONIC FILING OF A SEQUENCE LISTING

A Sequence Listing in ASCII text format, submitted under 37 C.F.R. § 1.821, entitled 1499-41_ST25, 1,019,971 bytes in size, generated on Jun. 30, 2021, and filed via EFS-Web, is provided in lieu of a paper copy. This Sequence Listing is hereby incorporated herein by reference into the specification for its disclosures.

FIELD

This invention relates to methods of modifying or editing a target nucleic acid such as methods that modify or edit adenine (A) to cytosine (C), thymine (T), or guanine (G). The invention further relates to compositions and systems for modifying or editing a target nucleic acid.

BACKGROUND OF THE INVENTION

While CRISPR-Cas9 and related technologies provide a way to generate targeted mutations within a loci, the type of product they generate is very deterministic. Current CRISPR technologies do not excel at generating allelic diversity in a semi-random way. For example, current base editing technology can only efficiently enable C to T or A to G transition mutations. Generation of allelic diversity can be valuable for discovery of novel phenotypes and traits. Accordingly, new methods capable of generating a diverse set of outcomes from a single tool would be advantageous.

SUMMARY OF THE INVENTION

A first aspect of the present invention is directed to a method of modifying a target nucleic acid, the method comprising: contacting the target nucleic acid with: a nucleic acid binding domain, a guide nucleic acid (e.g., a guide RNA), an adenine-modifying enzyme (e.g., an adenine deaminase), and a glycosylase, thereby modifying the target nucleic acid. In some embodiments, the nucleic acid binding domain is a CRISPR-Cas effector protein (e.g., a CRISPR enzyme).

Another aspect of the present invention is directed to a method of modifying a target nucleic acid, the method comprising: contacting the target nucleic acid with: a nucleic acid binding domain, a guide nucleic acid (e.g., a guide RNA), an adenine-modifying enzyme (e.g., an adenine deaminase), and a glycosylase, and modifying an adenine (A) of the target nucleic acid to a cytosine (C) and/or to a thymine (T), thereby modifying the target nucleic acid. In some embodiments, the nucleic acid binding domain is a CRISPR-Cas effector protein (e.g., a CRISPR enzyme).

A further aspect of the present invention is directed to a method of glycosylating a damaged adenine (e.g., an alkylated adenine, oxidized adenine, and/or inosine) present in a target nucleic acid, the method comprising: contacting the target nucleic acid with: a nucleic acid binding domain, a guide nucleic acid (e.g., a guide RNA), an adenine-modifying enzyme (e.g., an adenine deaminase), and a glycosylase; and glycosylating the damaged adenine, optionally using the glycosylase. The method may comprise generating the damaged adenine in the target nucleic acid, optionally using the nucleic acid binding domain, guide nucleic acid and/or adenine-modifying enzyme. In some embodiments, the nucleic acid binding domain is a CRISPR-Cas effector protein (e.g., a CRISPR enzyme).

Another aspect of the present invention is directed to a method of diversifying a target nucleic acid, the method comprising: contacting the target nucleic acid with: a nucleic acid binding domain, a guide nucleic acid (e.g., a guide RNA), an adenine-modifying enzyme (e.g., an adenine deaminase), and a glycosylase, thereby diversifying the target nucleic acid. In some embodiments, the nucleic acid binding domain is a CRISPR-Cas effector protein (e.g., a CRISPR enzyme).

An additional aspect of the present invention is directed to a base diversifying composition or system comprising: a nucleic acid binding domain, a guide nucleic acid (e.g., a guide RNA), an adenine-modifying enzyme (e.g., an adenine deaminase), and a glycosylase. In some embodiments, the nucleic acid binding domain is a CRISPR-Cas effector protein (e.g., a CRISPR enzyme).

Another aspect of the present invention is directed to a method of modifying a target nucleic acid, the method comprising: contacting the target nucleic acid with: a nucleic acid binding domain, a guide nucleic acid (e.g., a guide RNA), a cytosine deaminase, and an adenine deaminase, wherein the nucleic acid binding domain, cytosine deaminase, and adenine deaminase form a complex or are comprised in a complex, thereby modifying the target nucleic acid. The method may further comprise determining a desired or preferred phenotype using the modified target nucleic acid. In some embodiments, the nucleic acid binding domain is a CRISPR-Cas effector protein (e.g., a CRISPR enzyme).

Another aspect of the present invention is directed to a base editing composition or system comprising: a nucleic acid binding domain, a guide nucleic acid (e.g., a guide RNA), a cytosine deaminase, and an adenine deaminase, wherein the nucleic acid binding domain, cytosine deaminase, and adenine deaminase form a complex or are comprised in a complex. In some embodiments, the nucleic acid binding domain is a CRISPR-Cas effector protein (e.g., a CRISPR enzyme).

A further aspect of the present invention is directed to a method of modifying a target nucleic acid, the method comprising: contacting the target nucleic acid with: a nucleic acid binding domain, a guide nucleic acid (e.g., a guide RNA), and a cytosine deaminase, wherein the method modifies a cytosine (C) of the target nucleic acid to an adenine (A), guanine (G), or thymine (T), thereby modifying the target nucleic acid. The method may further comprise determining a desired or preferred phenotype using the modified target nucleic acid. In some embodiments, the nucleic acid binding domain is a CRISPR-Cas effector protein (e.g., a CRISPR enzyme).

Another aspect of the present invention is directed to a base editing composition or system comprising: a nucleic acid binding domain, a guide nucleic acid (e.g., a guide RNA), and a cytosine deaminase, wherein the composition or system is devoid of a glycosylase inhibitor (e.g., a uracil glycosylase inhibitor (UGI)). In some embodiments, the nucleic acid binding domain is a CRISPR-Cas effector protein (e.g., a CRISPR enzyme).

The invention further provides expression cassettes and/or vectors comprising a nucleic acid construct of the present invention, and cells comprising a polypeptide, fusion protein and/or nucleic acid construct of the present invention. Additionally, the invention provides kits comprising a nucleic acid construct of the present invention and expression cassettes, vectors and/or cells comprising the same.

It is noted that aspects of the invention described with respect to one embodiment, may be incorporated in a different embodiment although not specifically described relative thereto. That is, all embodiments and/or features of any embodiment can be combined in any way and/or combination. Applicant reserves the right to change any originally filed claim and/or file any new claim accordingly, including the right to be able to amend any originally filed claim to depend from and/or incorporate any feature of any other claim or claims although not originally claimed in that manner. These and other objects and/or aspects of the present invention are explained in detail in the specification set forth below. Further features, advantages and details of the present invention will be appreciated by those of ordinary skill in the art from a reading of the figures and the detailed description of the preferred embodiments that follow, such description being merely illustrative of the present invention.

BRIEF DESCRIPTION OF THE DRAWINGS

FIG. 7A is a graph providing the results for inosine glycosylase fusion constructs. FIG. 7B is a graph providing the results for inosine glycosylases provided in trans and overexpressed in the cell. FIG. 7C is a graph showing the amount of indels generated by the constructs.

FIG. 8A is a graph providing the results for inosine glycosylase for fusion constructs. FIG. 8B is a graph providing the results for inosine glycosylases provided in trans and overexpressed in the cell. FIG. 7C is a graph showing the amount of indels generated by the constructs.

DETAILED DESCRIPTION

Figure 1:
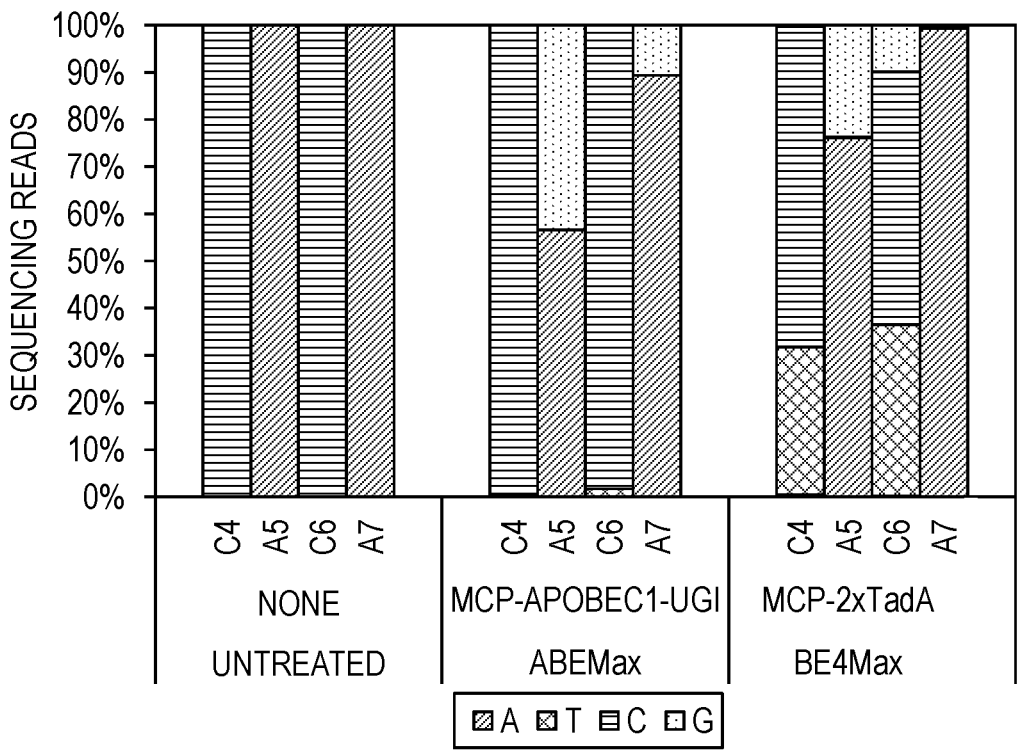
FIG. 1 is a graph showing C- and A-base editing results using a MS2/MCP system according to some embodiments of the present invention.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "enhance," "enhancing," "improve" and "improving" (and grammatical variations thereof) describe an elevation of at least about 5%, 10%, 15%, 20%, 25%, 30%, 35%, 40%, 45%, 50%, 55%, 60%, 65%, 70%, 75%, 80%, 85%, 90%, 95%, 100%, 150%, 200%, 300%, 400%, 500% or more such as compared to another measurable property or quantity (e.g., a control value).

As used herein, the terms "reduce," "reduced," "reducing," "reduction," "diminish," and "decrease" (and grammatical variations thereof), describe, for example, a decrease of at least about 5%, 10%, 15%, 20%, 25%, 30%, 35%, 40%, 45%, 50%, 55%, 60%, 65%, 70%, 75%, 80%, 85%, 90%, 95%, 97%, 98%, 99%, or 100% such as compared to another measurable property or quantity (e.g., a control value). In some embodiments, the reduction can result in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild-type" nucleic acid, nucleotide sequence, polypeptide or amino acid sequence refers to a naturally occurring or endogenous nucleic acid, nucleotide sequence, polypeptide or amino acid sequence. Thus, for example, a "wild-type mRNA" is an mRNA that is naturally occurring in or endogenous to the reference organism. A "homologous" nucleic acid sequence is a nucleotide sequence naturally associated with a host cell into which it is introduced.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "nucleic acid construct," "recombinant nucleic acid," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity with the comparator nucleotide sequence or it can mean less than 100% complementarity (e.g., "substantially complementary," such as about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence or polypeptide sequence will be understood to mean a nucleotide or polypeptide sequence of reduced length (e.g., reduced by 1, 2, 3, 4, 5, 6, 7, 8, 9, 10, 11, 12, 13, 14, 15, 16, 17, 18, 19, 20 or more residue(s) (e.g., nucleotide(s) or peptide(s)) relative to a reference nucleotide or polypeptide sequence, respectively, and comprising, consisting essentially of and/or consisting of a nucleotide or polypeptide sequence of contiguous residues, respectively, identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleotide or polypeptide sequence. Such a nucleic acid fragment or portion according to the invention may be, where appropriate, included in a larger polynucleotide of which it is a constituent. As an example, a repeat sequence of guide nucleic acid of this invention may comprise a portion of a wild-type CRISPR-Cas repeat sequence (e.g., a wild-type Type V CRISPR Cas repeat, e.g., a repeat from the CRISPR Cas system that includes, but is not limited to, Cas12a (Cpf1), Cas12b, Cas12c (C2c3), Cas12d (CasY), Cas12e (CasX), Cas12g, Cas12h, Cas12i, C2c1, C2c4, C2c5, C2c8, C2c9, C2c10, Cas14a, Cas14b, and/or Cas14c, and the like).

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, or more nucleotides in length, and any range therein, up to the full length of the sequence. In some embodiments, the nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40 nucleotides). In some embodiments, a substantially identical nucleotide or protein sequence performs substantially the same function as the nucleotide (or encoded protein sequence) to which it is substantially identical.

For sequence comparison, typically one sequence acts as a reference sequence to which test sequences are compared.

When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

A polynucleotide and/or recombinant nucleic acid construct of this invention can be codon optimized for expression. In some embodiments, a polynucleotide, nucleic acid construct, expression cassette, and/or vector of the present invention (e.g., that comprises/encodes a nucleic acid binding polypeptide (e.g., a DNA binding domain such as a sequence-specific DNA binding domain from a polynucleotide-guided endonuclease, a zinc finger nuclease, a transcription activator-like effector nuclease (TALEN), an Argonaute protein, and/or a CRISPR-Cas effector protein), a guide nucleic acid, a cytosine deaminase and/or adenine deaminase) may be codon optimized for expression in an organism (e.g., an animal, a plant, a fungus, an archaeon, or a bacterium). In some embodiments, the codon optimized nucleic acid constructs, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% or 100%) identity or more to the reference nucleic acid constructs, polynucleotides, expression cassettes, and/or vectors that have not been codon optimized.

In any of the embodiments described herein, a polynucleotide or nucleic acid construct of the invention may be operatively associated with a variety of promoters and/or other regulatory elements for expression in an organism or cell thereof (e.g., a plant and/or a cell of a plant). Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron maybe referred to as a "promoter region" (e.g., Ubi1 promoter and intron).

By "operably linked" or "operably associated" as used herein in reference to polynucleotides, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked," or "fused" in reference to polypeptides, refers to the attachment of one polypeptide to another. A polypeptide may be linked or fused to another polypeptide (at the N-terminus or the C-terminus) directly (e.g., via a peptide bond) or through a linker (e.g., a peptide linker).

The term "linker" in reference to polypeptides is art-recognized and refers to a chemical group, or a molecule linking two molecules or moieties, e.g., two domains of a fusion protein, such as, for example, a CRISPR-Cas effector protein and a peptide tag and/or a polypeptide of interest. A linker may be comprised of a single linking molecule (e.g., a single amino acid) or may comprise more than one linking molecule. In some embodiments, the linker can be an organic molecule, group, polymer, or chemical moiety such as a bivalent organic moiety. In some embodiments, the linker may be an amino acid or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g., extension of the hairpin structure in guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227). In some embodiments, a promoter region may comprise at least one intron (e.g., SEQ ID NO:1 or SEQ ID NO:2).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. *Gene* 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. *Gene* 403:132-142 (2007)) and Pdca1 is induced by salt (Li et al. *Mol Biol. Rep.* 37:1143-1154 (2010)).

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types.

Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *Arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the European patent publication EP0342926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as β-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, incorporated by reference herein for its disclosure of promoters. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); European patent EP 0452269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS11 from rice (Nguyen et al. *Plant Biotechnol. Reports* 9(5):297-306 (2015)), ZmSTK2_USP from maize (Wang et al. *Genome* 60(6):485-495 (2017)), LAT52 and LAT59 from tomato (Twell et al. *Development* 109(3):705-713 (1990)), Zm13 (U.S. Pat. No. 10,421,972), PLA$_2$-δ promoter from *Arabidopsis* (U.S. Pat. No. 7,141,424), and/or the ZmC5 promoter from maize (International PCT Publication No. WO1999/042587.

Additional examples of plant tissue-specific/tissue preferred promoters include, but are not limited to, the root hair-specific cis-elements (RHEs) (KIM ET AL. *The Plant Cell* 18:2958-2970 (2006)), the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology*, 37(8):1108-1115), corn light harvesting complex promoter (Bansal et al. (1992) *Proc. Natl. Acad. Sci. USA* 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: *Genetic Engineering of Plants* (Hollaender ed., Plenum Press 1983; and Poulsen et al. (1986) *Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), petunia chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) *Mol. Gen. Genet.* 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612).

Useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched at the onset of senescence, such as the SAG promoter from *Arabidopsis* (Gan et al. (1995) *Science* 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron.

Non-limiting examples of introns useful with the present invention include introns from the ADHI gene (e.g., Adh1-S introns 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof.

An "editing system" as used herein refers to any site-specific (e.g., sequence-specific) nucleic acid editing system now known or later developed, which system can introduce a modification (e.g., a mutation) in a nucleic acid in a target specific manner. For example, an editing system can include, but is not limited to, a CRISPR-Cas editing system, a meganuclease editing system, a zinc finger nuclease (ZFN) editing system, a transcription activator-like effector nuclease (TALEN) editing system, a base editing system and/or a prime editing system, each of which may comprise one or more polypeptide(s) and/or one or more polynucleotide(s) that when present and/or expressed together in a composition and/or cell can modify (e.g., mutate) a target nucleic acid in a sequence specific manner. In some embodiments, an editing system (e.g., a site- and/or sequence-specific editing system) comprises one or more polynucleotide(s) encoding for and/or one or more polypeptide(s) including but not limited to a nucleic acid binding polypeptide (e.g., a DNA binding domain) and/or a nuclease. In some embodiments, an editing system is encoded by one or more polynucleotide(s).

In some embodiments, an editing system comprises one or more sequence-specific nucleic acid binding polypeptide(s) (e.g., a DNA binding domain) that can be from, for example, a polynucleotide-guided endonuclease, a CRISPR-Cas effector protein (e.g., a CRISPR-Cas endonuclease), a zinc finger nuclease, a transcription activator-like effector nuclease (TALEN) and/or an Argonaute protein. In some embodiments, an editing system comprises one or more cleavage polypeptide(s) (e.g., a nuclease) such as, but not limited to, an endonuclease (e.g., Fok1), a polynucleotide-guided endonuclease, a CRISPR-Cas endonuclease, a zinc finger nuclease, and/or a transcription activator-like effector nuclease (TALEN).

A "nucleic acid binding polypeptide" as used herein refers to a polypeptide that binds and/or is capable of binding a nucleic acid in a site- and/or sequence specific manner. In some embodiments, a nucleic acid binding polypeptide comprises a DNA binding domain. In some embodiments, a nucleic acid binding polypeptide may be a sequence-specific nucleic acid binding polypeptide such as, but not limited to, a sequence-specific binding polypeptide and/or domain from, for example, a polynucleotide-guided endonuclease, a CRISPR-Cas effector protein (e.g., a CRISPR-Cas endonuclease), a zinc finger nuclease, a transcription activator-like effector nuclease (TALEN) and/or an Argonaute protein. In some embodiments, a nucleic acid binding polypeptide comprises a cleavage polypeptide (e.g., a nuclease polypeptide and/or domain) such as, but not limited to, an endonuclease (e.g., Fok1), a polynucleotide-guided endonuclease, a CRISPR-Cas endonuclease, a zinc finger nuclease, and/or a transcription activator-like effector nuclease (TALEN). In some embodiments, the nucleic acid binding polypeptide associates with and/or is capable of associating with (e.g., forms a complex with) one or more nucleic acid molecule(s) (e.g., forms a complex with a guide nucleic acid as described herein) that can direct or guide the nucleic acid binding polypeptide to a specific target nucleotide sequence (e.g., a gene locus of a genome) that is complementary to the one or more nucleic acid molecule(s) (or a portion or region thereof), thereby causing the nucleic acid binding polypeptide to bind to the nucleotide sequence at the specific target site. In some embodiments, the nucleic acid binding polypeptide is a CRISPR-Cas effector protein as described herein. In some embodiments, reference is made to specifically to a CRISPR-Cas effector protein for simplicity, but a nucleic acid binding polypeptide as described herein may be used.

In some embodiments, an editing system comprises a ribonucleoprotein such as an assembled ribonucleoprotein complex (e.g., a ribonucleoprotein that comprises a CRISPR-Cas effector protein and a guide nucleic acid in the form of complex). A complex of an editing system may be a covalently and/or non-covalently bound complex. An editing system, as used herein, may be assembled when introduced into a plant cell (e.g., assembled into a complex prior to introduction into the plant cell) and/or may assemble into a complex (e.g., a covalently and/or non-covalently bound complex) after and/or during introduction into a plant cell. Exemplary ribonucleoproteins and methods of use thereof include, but are not limited to, those described in Malnoy et al., (2016) Front. Plant Sci. 7:1904; Subburaj et al., (2016) Plant Cell Rep. 35:1535; Woo et al., (2015) Nat. Biotechnol. 33:1162; Liang et al., (2017) Nat. Commun. 8:14261; Svitashev et al., Nat. Commun. 7, 13274 (2016); Zhang et al., (2016) Nat. Commun. 7:12617; Kim et al., (2017) Nat. Commun. 8:14406.

An "edited cell," "edited plant," "edited plant part," "edited root," "edited callus," and/or the like as used herein refer to a cell, plant, plant part, root, callus, and/or the like, respectively, that comprises a modified nucleic acid in that a target nucleic acid been modified using an editing system as described herein to provide the modified nucleic acid. Thus, an "edited cell," "edited plant," "edited plant part," "edited root," "edited callus," and/or the like comprise a nucleic acid (i.e., a modified nucleic acid) that has been modified and/or changed compared to its unmodified or native sequence and/or structure.

The terms "transgene" or "transgenic" as used herein refer to at least one nucleic acid sequence that is taken from the genome of one organism, or produced synthetically, and which is then introduced into a host cell (e.g., a plant cell) or organism or tissue of interest and which is subsequently integrated into the host's genome by means of "stable" transformation or transfection approaches. In contrast, the term "transient" transformation or transfection or introduction refers to a way of introducing molecular tools including at least one nucleic acid (DNA, RNA, single-stranded or double-stranded or a mixture thereof) and/or at least one amino acid sequence, optionally comprising suitable chemical or biological agents, to achieve a transfer into at least one compartment of interest of a cell, including, but not restricted to, the cytoplasm, an organelle, including the nucleus, a mitochondrion, a vacuole, a chloroplast, or into a membrane, resulting in transcription and/or translation and/or association and/or activity of the at least one molecule introduced without achieving a stable integration or incorporation and thus inheritance of the respective at least one molecule introduced into the genome of a cell. The term "transgene-free" refers to a condition in which a transgene is not present or found in the genome of a host cell or tissue or organism of interest. In some embodiments, a polynucleotide and/or a nucleic acid construct of the invention can be an "expression cassette" or can be comprised within an expression cassette. As used herein, "expression cassette" means a recombinant nucleic acid molecule comprising, for example, a nucleic acid construct of the invention (e.g., a polynucleotide encoding a CRISPR-Cas effector protein, a polynucleotide encoding a CRISPR-Cas fusion protein, a polynucleotide encoding a cytosine deaminase, a polynucleotide encoding an adenine deaminase, a polynucleotide encoding a deaminase fusion protein, a polynucleotide encoding a peptide tag, a polynucleotide encoding an affinity polypeptide, a polynucleotide encoding an adenine-modifying enzyme, a polynucleotide encoding a glycosylase, and/or a polynucleotide comprising a guide nucleic acid), wherein the nucleic acid construct is operably associated with at least a control sequence (e.g., a promoter). Thus, some embodiments of the invention provide expression cassettes designed to express, for example, a nucleic acid construct of the invention. When an expression cassette comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination). Thus, for example, a polynucleotide encoding a CRISPR-Cas effector protein, a polynucleotide encoding a an adenine-modifying enzyme, a polynucleotide encoding a glycosylase, and a polynucleotide comprising a guide nucleic acid comprised in an expression cassette may each be operably associated with a single promoter or one or more of the polynucleotide(s) may be operably associated with separate promoters (e.g., two or three promoters in any combination), which may be the same or different from each other.

In some embodiments, an expression cassette comprising the polynucleotides/nucleic acid constructs of the invention may be optimized for expression in an organism (e.g., an animal, a plant, a bacterium and the like).

An expression cassette comprising a nucleic acid construct of the invention may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native to a gene encoding a CRISPR-Cas effector protein or a gene encoding a deaminase, may be native to a host cell, or may be native to another source (e.g., foreign or heterologous to the promoter, to a gene encoding the CRISPR-Cas effector protein or a gene encoding the deaminase, to a host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

The expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid construct comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self transmissible or mobilizable. In some embodiments, a viral vector can include, but is not limited, to a retroviral, lentiviral, adenoviral, adeno-associated, or herpes simplex viral vector. A vector as defined herein can transform a prokaryotic or eukaryotic host either by integration into the cellular genome or exist extrachromosomally (e.g., autonomous replicating plasmid with an origin of replication). Additionally, included are shuttle vectors by which is meant a DNA vehicle capable, naturally or by design, of replication in two different host organisms, which may be selected from actinomycetes and related species, bacteria and eukaryotic (e.g., higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. Accordingly, a nucleic acid construct of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). Thus, for example, a target nucleic acid may be contacted with a nucleic acid construct of the invention encoding, for example, a nucleic acid binding polypeptide (e.g., a DNA binding domain such as a sequence-specific DNA binding protein (e.g., a polynucleotide-guided endonuclease, a CRISPR-Cas effector protein (e.g., CRISPR-Cas endonuclease), a zinc finger nuclease, a transcription activator-like effector nuclease (TALEN) and/or an Argonaute protein)), a guide nucleic acid, and a cytosine deaminase and/or adenine deaminase under conditions whereby the nucleic acid binding polypeptide is expressed, and the nucleic acid binding polypeptide (e.g., CRISPR-Cas effector protein) forms a complex with the guide nucleic acid, the complex hybridizes to the target nucleic acid, and optionally the cytosine deaminase and/or adenine deaminase is/are recruited to the nucleic acid binding polypeptide (and thus, to the target nucleic acid) or the cytosine deaminase and/or adenine deaminase are fused to the nucleic acid binding polypeptide, thereby modifying the target nucleic acid. In some embodiments, a CRISPR-Cas effector protein, a guide nucleic acid, and a deaminase contact a target nucleic acid to thereby modify the nucleic acid. In some embodiments, the CRISPR-Cas effector protein, a guide nucleic acid, and/or a deaminase may be in the form of a complex (e.g., a ribonucleoprotein such as an assembled ribonucleoprotein complex) and the complex contacts the target nucleic acid. In some embodiments, the complex or a component thereof (e.g., the guide nucleic acid) hybridizes to the target nucleic acid and thereby the target nucleic acid is modified (e.g., via action of the CRISPR-Cas effector protein and/or deaminase). In some embodiments, the cytosine deaminase and/or adenine deaminase and the nucleic acid binding polypeptide localize at the target nucleic acid, optionally through covalent and/or non-covalent interactions.

As used herein, "modifying" or "modification" in reference to a target nucleic acid includes editing (e.g., mutating), covalent modification, exchanging/substituting nucleic acids/nucleotide bases, deleting, cleaving, and/or nicking of a target nucleic acid to thereby provide a modified nucleic acid and/or altering transcriptional control of a target nucleic acid to thereby provide a modified nucleic acid. In some embodiments, a modification may include an insertion and/or deletion of any size and/or a single base change (SNP) of any type. In some embodiments, a modification comprises a SNP. In some embodiments, a modification comprises exchanging and/or substituting one or more (e.g., 1, 2, 3, 4, 5, or more) nucleotides. In some embodiments, an insertion or deletion may be about 1 base to about 30,000 bases in length (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, 30,000 bases in length or more, or any value or range therein). Thus, in some embodiments, an insertion or deletion may be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300 to about 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 bases in length, or any range or value therein; about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300 bases to about 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000 bases or more in length, or any value or range therein; about 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000 bases to about 2500, 3000, 3500, 4000, 4500, 5000, 5500, 6000, 6500, 7000, 7500, 8000, 8500, 9000, 9500, or 10,000 bases or more in length, or any value or range therein; or about 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, or 700 bases to about 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, or 5000 bases or more in length, or any value or range therein. In some embodiments, an insertion or deletion may be about 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, or 10,000 bases to about 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, or 30,000 bases or more in length, or any value or range therein.

"Recruit," "recruiting" or "recruitment" as used herein refer to attracting one or more polypeptide(s) or polynucleotide(s) to another polypeptide or polynucleotide (e.g., to a particular location in a genome) using protein-protein interactions, nucleic acid-protein interactions (e.g., RNA-protein interactions), and/or chemical interactions. Protein-protein interactions can include, but are not limited to, peptide tags (epitopes, multimerized epitopes) and corresponding affinity polypeptides, RNA recruiting motifs and corresponding affinity polypeptides, and/or chemical interactions. Example chemical interactions that may be useful with polypeptides and polynucleotides for the purpose of recruitment can include, but are not limited to, rapamycin-inducible dimerization of FRB-FKBP; Biotin-streptavidin interaction; SNAP tag (Hussain et al. *Curr Pharm Des.* 19(30):5437-42 (2013)); Halo tag (Los et al. *ACS Chem Biol.* 3(6):373-82

(2008)); CLIP tag (Gautier et al. *Chemistry & Biology* 15:128-136 (2008)); DmrA-DmrC heterodimer induced by a compound (Tak et al. *Nat Methods* 14(12):1163-1166 (2017)); Bifunctional ligand approaches (fuse two protein-binding chemicals together) (Voß et al. *Curr Opin Chemical Biology* 28:194-201 (2015)) (e.g. dihydrofolate reductase (DHFR) (Kopyteck et al. Cell Chem Biol 7(5):313-321 (2000)).

"Introducing," "introduce," "introduced" (and grammatical variations thereof) in the context of a polynucleotide of interest means presenting a nucleotide sequence of interest (e.g., polynucleotide, a nucleic acid construct, and/or a guide nucleic acid) to a host organism or cell of said organism (e.g., host cell; e.g., a plant cell) in such a manner that the nucleotide sequence gains access to the interior of a cell. Thus, for example, a nucleic acid construct of the invention encoding a CRISPR-Cas effector protein, a guide nucleic acid, and a cytosine deaminase and/or adenine deaminase may be introduced into a cell of an organism, thereby transforming the cell with the CRISPR-Cas effector protein, a guide nucleic acid, and a cytosine deaminase and/or adenine deaminase. In some embodiments, a polypeptide comprising a nucleic acid binding polypeptide (e.g., a CRISPR-Cas effector protein) and/or a guide nucleic acid may be introduced into a cell of an organism, optionally wherein the nucleic acid binding polypeptide and guide nucleic acid may be comprised in a complex (e.g., a ribonucleoprotein). In some embodiments, the organism is a eukaryote (e.g., a mammal such as a human).

The term "transformation" as used herein refers to the introduction of a heterologous nucleic acid into a cell. Transformation of a cell may be stable or transient. Thus, in some embodiments, a host cell or host organism may be stably transformed with a polynucleotide/nucleic acid molecule of the invention. In some embodiments, a host cell or host organism may be transiently transformed with a nucleic acid construct of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention may be transiently introduced into a cell with a guide nucleic acid and as such, no DNA maintained in the cell.

A nucleic acid construct of the invention can be introduced into a cell by any method known to those of skill in the art. In some embodiments, transformation methods include, but are not limited to, transformation via bacterial-mediated nucleic acid delivery (e.g., via Agrobacteria), viral-mediated nucleic acid delivery, silicon carbide and/or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. In some embodiments of the invention, transformation of a cell comprises nuclear transformation. In some embodiments, transformation of a cell comprises plastid transformation (e.g., chloroplast transformation). In some embodiments, a recombinant nucleic acid construct of the invention can be introduced into a cell via conventional breeding techniques.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281-2308 (2013)). General guides to various plant transformation methods known in the art include Miki et al. ("Procedures for Introducing Foreign DNA into Plants" in Methods in Plant Molecular Biology and Biotechnology, Glick, B. R. and Thompson, J. E., Eds. (CRC Press, Inc., Boca Raton, 1993), pages 67-88) and Rakowoczy-Trojanowska (Cell. Mol. Biol. Lett. 7:849-858 (2002)).

A polynucleotide and/or polypeptide can be introduced into a host organism or its cell (optionally a plant, plant part, and/or plant cell) in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. A polynucleotide and/or polypeptide can be introduced into the cell of interest in a single transformation event, and/or in separate transformation events, or, alternatively, a polynucleotide and/or polypeptide can be incorporated into a plant, for example, as part of a breeding protocol. In some embodiments, the cell is a eukaryotic cell (e.g., a mammalian such as a human cell or a plant cell).

According to some embodiments, provided is a base diversifying composition or system comprising: a CRISPR-Cas effector protein (e.g., a CRISPR enzyme), a guide nucleic acid (e.g., a guide RNA), an adenine-modifying enzyme (e.g., an adenine deaminase), and a glycosylase. The CRISPR-Cas effector protein, adenine-modifying enzyme, guide nucleic acid, and/or glycosylase may form a complex or may be comprised in a complex. In some embodiments, the CRISPR-Cas effector protein is a Type V CRISPR-Cas effector protein. In some embodiments, the glycosylase may be linked to the CRISPR-Cas effector protein and/or to the adenine-modifying enzyme. In some embodiments, the present invention provides a nucleic acid construct comprising: a CRISPR-Cas effector protein (e.g., a CRISPR enzyme), a guide nucleic acid (e.g., a guide RNA), an adenine-modifying enzyme and/or a glycosylase, each as described herein.

According to some embodiments, provided is a base editing composition or system comprising: a CRISPR-Cas effector protein (e.g., a CRISPR enzyme), a guide nucleic acid (e.g., a guide RNA), a cytosine deaminase, and an adenine deaminase, wherein the CRISPR-Cas effector protein, cytosine deaminase, and adenine deaminase form a complex or are comprised in a complex. In some embodiments, the complex further comprises the guide nucleic acid. In some embodiments, the CRISPR-Cas effector protein is a Type V CRISPR-Cas effector protein. In some embodiments, the present invention provides a nucleic acid construct comprising: a CRISPR-Cas effector protein (e.g., a CRISPR enzyme), a guide nucleic acid (e.g., a guide RNA), a cytosine deaminase, and an adenine deaminase, each as described herein. The nucleic acid construct may further comprise a glycosylase inhibitor (e.g., a uracil glycosylase inhibitor (UGI)).

The guide nucleic acid may comprise a RNA recruiting motif (e.g., one or more MS2 hairpin(s)) as described herein. In some embodiments, the CRISPR-Cas effector protein interacts with, binds to, and/or complexes with a guide nucleic acid (e.g., a guide RNA).

The CRISPR-Cas effector protein may be fused to a glycosylase inhibitor, the cytosine deaminase and/or the adenine deaminase. In some embodiments, the CRISPR-Cas effector protein is fused to the cytosine deaminase and/or the adenine deaminase in a single fusion or separately to one or both of the cytosine deaminase and/or the adenine deaminase. In some embodiments, the CRISPR-Cas effector protein is fused to the cytosine deaminase. In some embodiments, the CRISPR-Cas effector protein is fused to the adenine deaminase. In some embodiments, the CRISPR-Cas effector protein is fused to the cytosine deaminase and the adenine deaminase. In some embodiments, the cytosine deaminase and/or adenine deaminase is/are not fused to Cas9 and/or optionally the cytosine deaminase and/or adenine deaminase may be recruited to a target site via a non-covalent interaction. In some embodiments, the cytosine deaminase and/or adenine deaminase is/are fused or recruited to a Type V CRISPR-Cas domain (e.g., Cpf1). In some embodiments, the cytosine deaminase and/or adenine deaminase is/are recruited to a Type V CRISPR-Cas domain (e.g., Cpf1).

In some embodiments, the cytosine deaminase and adenine deaminase are fused together. In some embodiments, the cytosine deaminase and/or adenine deaminase comprise a MS2 capping protein (MCP) or a portion thereof. A MCP or portion thereof may be fused to both the cytosine deaminase and adenine deaminase in a single fusion or separately to one or both of the cytosine deaminase and adenine deaminase. For example, in some embodiments, the cytosine deaminase may be separately fused to a MCP or portion thereof and/or, in some embodiments, the adenine deaminase may be separately fused to a MCP or portion thereof. The MCP or portion thereof may bind or be capable of binding to an RNA recruiting motif as described herein such as a MS2 hairpin.

In some embodiments, a glycosylase inhibitor is fused to the CRISPR-Cas effector protein, cytosine deaminase, and/ or adenine deaminase. In some embodiments, a glycosylase inhibitor is fused to the CRISPR-Cas effector protein. In some embodiments, a glycosylase inhibitor is fused to the cytosine deaminase and the adenine deaminase in a single fusion or separately to one or both of the cytosine deaminase and adenine deaminase. For example, in some embodiments, the cytosine deaminase may be separately fused to a glycosylase inhibitor and/or, in some embodiments, the adenine deaminase may be separately fused to a glycosylase inhibitor.

In some embodiments, the CRISPR-Cas effector protein comprises one or more (e.g., 1, 2, 4, 6, 8, 10, or more) peptide tag(s) as described herein. In some embodiments, the peptide tag may be a SunTag and/or the peptide tag may comprise one or more (e.g., 1, 2, 3, 4, or more) GCN4 epitope(s).

In some embodiments, the adenine deaminase and/or cytosine deaminase comprise an affinity polypeptide (e.g., an scFv) as described herein and the affinity polypeptide may be capable of binding a peptide tag (e.g., a peptide tag fused to a CRISPR-Cas effector protein). In some embodiments, an affinity polypeptide is fused to both the cytosine deaminase and the adenine deaminase in a single fusion or an affinity polypeptide is separately fused to one or both of the cytosine deaminase and adenine deaminase. When an affinity polypeptide is separately fused to both the cytosine deaminase and adenine deaminase, the affinity polypeptide fused to the cytosine deaminase may be the same as or different than the affinity polypeptide fused to the adenine deaminase.

In some embodiments, the adenine deaminase and/or cytosine deaminase comprise one or more (e.g., 1, 2, 4, 6, 8, 10, or more) peptide tag(s). In some embodiments, the peptide tag may be a SunTag and/or the peptide tag may comprise one or more (e.g., 1, 2, 3, 4, or more) GCN4 epitope(s). In some embodiments, a peptide tag is fused to both the cytosine deaminase and the adenine deaminase in a single fusion or a peptide tag is separately fused to one or both of the cytosine deaminase and adenine deaminase. When a peptide tag is separately fused to both the cytosine deaminase and adenine deaminase, the peptide tag fused to the cytosine deaminase may be the same as or different than the peptide tag fused to the adenine deaminase.

In some embodiments, the CRISPR-Cas effector protein comprises an affinity polypeptide (e.g., an scFv) as described herein and the affinity polypeptide may be capable of binding a peptide tag (e.g., a peptide tag fused to an adenine deaminase and/or cytosine deaminase).

In some embodiments, the adenine deaminase and/or cytosine deaminase comprise a DNA binding polypeptide. In some embodiments, a fusion protein of the present invention comprises a CRISPR-Cas effector protein, a DNA binding polypeptide, and an adenine deaminase and/or cytosine deaminase. In some embodiments, a DNA binding polypeptide is not fused or linked to a different polypeptide. In some embodiments, a DNA binding polypeptide is expressed in a cell, optionally in a nucleic acid construct of the present invention that is present in a cell and/or introduced into a cell. A "DNA binding polypeptide" as used herein refers to a protein or a polypeptide or domain thereof that can bind to or is capable of binding to DNA nonspecifically and/or specifically (e.g., in a site- and/or sequence specific manner). In some embodiments, an adenine deaminase and/or cytosine deaminase is fused (e.g., linked) to a DNA binding polypeptide that optionally binds to DNA nonspecifically, and optionally a CRISPR-Cas effector protein is fused to the deaminase and/or to the DNA binding polypeptide. In some embodiments, a DNA binding polypeptide binds to at least one DNA strand, optionally to one or both strands of a double-stranded DNA. In some embodiments, a DNA binding polypeptide binds to one or both ends of a double-stranded DNA break. In some embodiments, a DNA binding polypeptide binds to a double-strand break, traps a double-strand break, and/or does not bind to any proteins. In some embodiments, a DNA binding polypeptide has at least 70%, 75%, 80%, 85%, 90%, 95%, 96%, 97%, 98%, 99%, or more sequence identity to SEQ ID NO:282 or SEQ ID NO:283, optionally wherein a DNA binding polypeptide comprises a sequence of SEQ ID NO:282 or SEQ ID NO:283. In some embodiments, a DNA binding polypeptide comprises at least about 50%, 55%, 60%, 65%, 70%, 75%, 80%, 85%, 90%, 95%, 96%, 97%, 98%, 99%, or more consecutive amino acids of SEQ ID NO:282 or SEQ ID NO:283. In some embodiments, the DNA binding polypeptide reduces or minimizes the formation of undesired indels during modification of a target nucleic acid (e.g., during base editing), increases efficiency of modifying a target nucleic acid (e.g., increases efficiency of base editing), increases or improves base diversification activity, and/or increases accuracy of modifying a target nucleic acid.

According to some embodiments, provided is a base editing composition or system comprising: a CRISPR-Cas effector protein (e.g., a CRISPR enzyme), a guide nucleic acid (e.g., a guide RNA), and a cytosine deaminase, wherein the composition or system is devoid of a glycosylase inhibitor (e.g., a uracil glycosylase inhibitor (UGI) such as a uracil-N-glycosylase (UNG) inhibitor). In some embodiments, a base editing composition or system comprises: a CRISPR-Cas effector protein (e.g., a CRISPR enzyme), a guide nucleic acid (e.g., a guide RNA), and a cytosine deaminase, wherein the CRISPR-Cas effector protein, cytosine deaminase, and optionally guide nucleic acid form a complex or are comprised in a complex, optionally wherein the complex is devoid of a glycosylase inhibitor (e.g., a UGI such as a UNG inhibitor). In some embodiments, the present invention provides a nucleic acid construct comprising: a CRISPR-Cas effector protein (e.g., a CRISPR enzyme), a guide nucleic acid (e.g., a guide RNA), and a cytosine deaminase, optionally wherein the nucleic acid construct is devoid of a glycosylase inhibitor (e.g., a UGI such as a UNG inhibitor). In some embodiments, the composition, system, and/or nucleic acid construct comprises a glycosylase domain. The guide nucleic acid may have less than complete complementarity to a target nucleic acid such as less than 100% complementarity (e.g., less than 99%, 98%, 97%, 96%, 95%, 94%, 93%, 92%, 91%, 90%, etc.). The cytosine deaminase may be one or more of rAPOBEC1, APOBEC3A, APOBEC3B, hAID, and pmCDA1. The CRISPR-Cas effector protein may comprise a Type V CRISPR-Cas effector protein and/or a Type II CRISPR-Cas effector protein such as Cas9, optionally a Cas9 that has an attenuated interaction with a target nucleic acid. In some embodiments, the CRISPR-Cas effector protein may comprise (e.g., is fused to) an exogenous polymerase that is optionally codon-optimized. In some embodiments, the CRISPR-Cas effector protein comprises a peptide tag (e.g., a SunTag) as described herein and the cytosine deaminase comprises an affinity polypeptide (e.g., an scFv) capable of binding the peptide tag, optionally wherein the cytosine deaminase and the affinity polypeptide are fused together. In some embodiments, the cytosine deaminase comprises a peptide tag (e.g., a SunTag) as described herein and the CRISPR-Cas effector protein comprises an affinity polypeptide (e.g., an scFv) capable of binding the peptide tag, optionally wherein the CRISPR-Cas effector protein and the affinity polypeptide are fused together. In some embodiments, the cytosine deaminase comprises a MCP or a portion thereof, optionally wherein the MCP or portion thereof is fused to the N-terminus of the cytosine deaminase amino acid sequence. In some embodiments, the cytosine deaminase comprises (e.g., is fused to) a Cas9, a Cas12, a Cas13, or a Cas14 domain. In some embodiments, the cytosine deaminase comprises a Cas9 domain, optionally wherein the cytosine deaminase is fused to the Cas9 domain. In some embodiments, the cytosine deaminase comprises a deactivated LbCpf1 (dLbCpf1), optionally wherein the cytosine deaminase is fused to dLbCpf1. In some embodiments, the cytosine deaminase is codon-optimized, optionally for monocot expression and/or dicot expression.

In some embodiments, the CRISPR-Cas effector protein may comprise a Cas12a (Cpf1) effector protein or polypeptide or domain thereof, for example, a LbCpf1 [Lachnospiraceae bacterium], AsCpf1 [*Acidaminococcus* sp.], BpCpf1 [*Butyrivibrio proteoclasticus*], CMtCpf1 [*Candidatus methanoplasma termitum*], EeCpf1 [*Eubacterium eligens*], FnCpf1 (*Francisella novicida* U112), Lb2Cpf1 [Lachnospiraceae bacterium], >Lb3Cpf1 [Lachnospiraceae bacterium], LiCpf1 [*Leptospira inadai*], MbCpf1 [*Moraxella bovoculi* 237], PbCpf1 [Parcubacteria bacterium GWC2011_GWC2_44_17], PcCpf1 [*Porphyromonas crevioricanis*], PdCpf1 [*Prevotella disiens*], PeCpf1 [Peregrinibacteria bacterium GW2011_GWA_33_10], PmCpf1 [*Porphyromonas macacae*], and/or a SsCpf1 [*Smithella* sp. SC K08D17] (e.g., SEQ ID NOs:3-22). In some embodiments, the Cas12a effector protein domain may be a Lachnospiraceae bacterium ND2006 Cas12a (LbCas12a)(LbCpf1) (e.g., SEQ ID NOs:3 or 9-11), an *Acidaminococcus* sp. Cpf1 (AsCas12a) (AsCpf1) (e.g., SEQ ID NO:4) and/or enAsCas12a (e.g., SEQ ID NOs:20-22).

In some embodiments, a nucleic acid construct of the invention (e.g., a polynucleotide encoding a CRISPR-Cas effector protein, a polynucleotide encoding a CRISPR-Cas fusion protein, a polynucleotide encoding a deaminase, a polynucleotide encoding a deaminase fusion protein, a polynucleotide encoding a peptide tag, a polynucleotide encoding an affinity polypeptide, an RNA recruiting motif, a recruiting guide nucleic acid and/or a guide nucleic acid and/or expression cassettes and/or vectors comprising the same) may be operably linked to at least one regulatory sequence, optionally, wherein the at least one regulatory sequence may be codon optimized for expression in a plant. In some embodiments, the at least one regulatory sequence may be, for example, a promoter, an operon, a terminator, or an enhancer. In some embodiments, the at least one regulatory sequence may be a promoter. In some embodiments, the regulatory sequence may be an intron. In some embodiments, the at least one regulatory sequence may be, for example, a promoter operably associated with an intron or a promoter region comprising an intron. In some embodiments, the at least one regulatory sequence may be, for example a ubiquitin promoter and its associated intron (e.g., *Medicago truncatula* and/or *Zea mays* and their associated introns). In some embodiments, the at least one regulatory sequence may be a terminator nucleotide sequence and/or an enhancer nucleotide sequence.

In some embodiments, a nucleic acid construct of the invention may be operably associated with a promoter region, wherein the promoter region comprises an intron, optionally wherein the promoter region may be a ubiquitin promoter and intron (e.g., a *Medicago* or a maize ubiquitin promoter and intron, e.g., SEQ ID NO:1 or SEQ ID NO:2). In some embodiments, the nucleic acid construct of the invention that is operably associated with a promoter region comprising an intron may be codon optimized for expression in a plant.

In some embodiments, a nucleic acid construct of the invention may encode one or more polypeptides of interest, optionally wherein the one or more polypeptides of interest may be codon optimized for expression in a plant.

A polypeptide of interest useful with this invention can include, but is not limited to, a polypeptide or protein domain having deaminase activity, nickase activity, recombinase activity, transposase activity, methylase activity, glycosylase (DNA glycosylase) activity, glycosylase inhibitor activity (e.g., uracil-DNA glycosylase inhibitor (UGI)), demethylase activity, transcription activation activity, transcription repression activity, transcription release factor activity, histone modification activity, nuclease activity, single-strand RNA cleavage activity, double-strand RNA cleavage activity, restriction endonuclease activity (e.g., Fok1), nucleic acid binding activity, methyltransferase activity, DNA repair activity, DNA damage activity, dismutase activity, alkylation activity, depurination activity, oxidation activity, pyrimidine dimer forming activity, integrase activity, transposase activity, polymerase activity, ligase activity, helicase activity, a nuclear localization sequence or activity, and/or photolyase activity. In some embodiments, the polypeptide of interest is a Fok1 nuclease, or a uracil-DNA glycosylase inhibitor. In some embodiments, the polypeptide of interest is a polypeptide that reduces or minimizes the formation of undesired indels during base editing, increases modification of a target nucleic acid (e.g., during base editing), increases efficiency of modifying a target nucleic acid (e.g., increases efficiency of base editing), increases or improves base diversification activity, and/or increases accuracy of modifying a target nucleic acid. When encoded in a nucleic acid (polynucleotide, expression cassette, and/or vector) the encoded polypeptide or protein domain may be codon optimized for expression in an organism. In some embodiments, a polypeptide of interest may be linked to a CRISPR-Cas effector protein to provide a CRISPR-Cas fusion protein comprising the CRISPR-Cas effector protein and the polypeptide of interest. In some embodiments, a CRISPR-Cas fusion protein that comprises a CRISPR-Cas effector protein linked to a peptide tag may also be linked to a polypeptide of interest (e.g., a CRISPR-Cas effector protein may be, for example, linked to both a peptide tag (or an affinity polypeptide) and, for example, a polypeptide of interest, e.g., a UGI). In some embodiments, a polypeptide of interest may be a uracil glycosylase inhibitor (e.g., uracil-DNA glycosylase inhibitor (UGI)). In some embodiments, a polypeptide of interest may be linked to a cytosine deaminase and/or adenine deaminase to provide a deaminase fusion protein comprising the cytosine deaminase and/or adenine deaminase and the polypeptide of interest. In some embodiments, a polypeptide of interest may be expressed in a cell (e.g., a plant cell) and may not be fused to another polypeptide.

In some embodiments, a nucleic acid construct of the invention encoding a CRISPR-Cas effector protein and a cytosine deaminase and/or adenine deaminase and comprising a guide nucleic acid may further encode a polypeptide of interest, optionally wherein the polypeptide of interest may be codon optimized for expression in an organism (e.g., a plant or mammal).

As used herein, a "CRISPR-Cas effector protein" is a protein or polypeptide or domain thereof that cleaves, cuts, or nicks a nucleic acid, binds a nucleic acid (e.g., a target nucleic acid and/or a guide nucleic acid), and/or that identifies, recognizes, or binds a guide nucleic acid as defined herein. In some embodiments, a CRISPR-Cas effector protein may be an enzyme (e.g., a nuclease, endonuclease, nickase, etc.) or portion thereof and/or may function as an enzyme. In some embodiments, a CRISPR-Cas effector protein refers to a CRISPR-Cas nuclease polypeptide or domain thereof that comprises nuclease activity or in which the nuclease activity has been reduced or eliminated, and/or comprises nickase activity or in which the nickase has been reduced or eliminated, and/or comprises single stranded DNA cleavage activity (ss DNAse activity) or in which the ss DNAse activity has been reduced or eliminated, and/or comprises self-processing RNAse activity or in which the self-processing RNAse activity has been reduced or eliminated. A CRISPR-Cas effector protein may bind to a target nucleic acid. A CRISPR-Cas effector protein may be a Type I, II, III, IV, V, or VI CRISPR-Cas effector protein. In some embodiments, a CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be a Type II CRISPR-Cas effector protein, for example, a Cas9 effector protein. In some embodiments, a CRISPR-Cas effector protein may be Type V CRISPR-Cas effector protein, for example, a Cas12 effector protein.

In some embodiments, a CRISPR-Cas effector protein may be or include, but is not limited to, a Cas9, C2c1, C2c3, Cas12a (also referred to as Cpf1), Cas12b, Cas12c, Cas12d, Cas12e, Cas13a, Cas13b, Cas13c, Cas13d, Casl, CaslB, Cas2, Cas3, Cas3', Cas3", Cas4, Cas5, Cas6, Cas7, Cas8, Cas9 (also known as Csn1 and Csx12), Cas10, Csyl, Csy2, Csy3, Csel, Cse2, Cscl, Csc2, Csa5, Csn2, Csm2, Csm3, Csm4, Csm5, Csm6, Cmrl, Cmr3, Cmr4, Cmr5, Cmr6, Csbl, Csb2, Csb3, Csxl7, Csxl4, Csx10, Csx16, CsaX, Csx3, Csxl, Csxl5, Csfl, Csf2, Csf3, Csf4 (dinG), and/or Csf5 nuclease, optionally wherein the CRISPR-Cas effector protein may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c effector protein.

In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," e.g., dCas9. In some embodiments, a CRISPR-Cas effector protein domain or polypeptide having a mutation in its nuclease active site may have impaired activity or reduced activity as compared to the same CRISPR-Cas effector protein without the mutation, e.g., a nickase, e.g, Cas9 nickase, Cas12a nickase.

A CRISPR Cas9 effector protein or CRISPR Cas9 effector domain useful with this invention may be any known or later identified Cas9 nuclease. In some embodiments, a CRISPR Cas9 polypeptide can be a Cas9 polypeptide from, for example, *Streptococcus* spp. (e.g., *S. pyogenes, S. thermophilus*), *Lactobacillus* spp., *Bifidobacterium* spp., *Kandleria* spp., *Leuconostoc* spp., *Oenococcus* spp., *Pediococcus* spp., *Weissella* spp., and/or *Olsenella* spp. In some embodiments, a CRISPR-Cas effector protein may be a Cas9 polypeptide or domain thereof and optionally may have a nucleotide sequence of any one of SEQ ID NOs:23-37 and/or an amino acid sequence of any one of SEQ ID NOs:38-39.

In some embodiments, the CRISPR-Cas effector protein may be a Cas9 polypeptide derived from *Streptococcus pyogenes* and recognizes the PAM sequence motif NGG, NAG, NGA (Mali et al, Science 2013; 339(6121): 823-826). In some embodiments, the CRISPR-Cas effector protein may be a Cas9 polypeptide derived from *Streptococcus thermophiles* and recognizes the PAM sequence motif NGGNG and/or NNAGAAW (W=A or T) (See, e.g., Horvath et al, Science, 2010; 327(5962): 167-170, and Deveau et al, J Bacteriol 2008; 190(4): 1390-1400). In some embodiments, the CRISPR-Cas effector protein may be a Cas9 polypeptide derived from *Streptococcus mutans* and recognizes the PAM sequence motif NGG and/or NAAR (R=A or G) (See, e.g., Deveau et al, J BACTERIOL 2008; 190(4): 1390-1400). In some embodiments, the CRISPR-Cas effector protein may be a Cas9 polypeptide derived from *Streptococcus aureus* and recognizes the PAM sequence motif NNGRR (R=A or G). In some embodiments, the CRISPR-Cas effector protein may be a Cas9 protein derived from *S. aureus*, which recognizes the PAM sequence motif N GRRT (R=A or G). In some embodiments, the CRISPR-Cas effector protein may be a Cas9 polypeptide derived from *S. aureus*, which recognizes the PAM sequence motif N GRRV (R=A or G). In some embodiments, the CRISPR-Cas effector protein may be a Cas9 polypeptide that is derived from *Neisseria meningitidis* and recognizes the PAM sequence motif N GATT or N GCTT (R=A or G, V=A, G or C) (See, e.g., Hou et ah, PNAS 2013, 1-6). In any of the aforementioned embodiments, N can be any nucleotide residue, e.g., any of A, G, C or T. In some embodiments, the CRISPR-Cas effector protein may be a Cas13a protein derived from *Leptotrichia shahii*, which recognizes a protospacer flanking sequence (PFS) (or RNA PAM (rPAM)) sequence motif of a single 3' A, U, or C, which may be located within the target nucleic acid.

A Type V CRISPR-Cas effector protein useful with embodiments of the invention may be any Type V CRISPR-Cas nuclease. A Type V CRISPR-Cas nuclease useful with this invention as an effector protein can include, but is not limited to, Cas12a (Cpf1), Cas12b, Cas12c (C2c3), Cas12d (CasY), Cas12e (CasX), Cas12g, Cas12h, Cas12i, C2c1, C2c4, C2c5, C2c8, C2c9, C2c10, Cas14a, Cas14b, and/or Cas14c nuclease. In some embodiments, a Type V CRISPR-Cas nuclease polypeptide or domain useful with embodiments of the invention may be a Cas12a polypeptide or domain. In some embodiments, a Type V CRISPR-Cas effector protein or domain useful with embodiments of the invention may be a nickase, optionally, a Cas12a nickase. In some embodiments, a CRISPR-Cas effector protein may be a Cas12a polypeptide or domain thereof and optionally may have an amino acid sequence of any one of SEQ ID NOs:3-19 and/or a nucleotide sequence of any one of SEQ ID NOs:20-22.

In some embodiments, the CRISPR-Cas effector protein may be derived from Cas12a, which is a Type V Clustered Regularly Interspaced Short Palindromic Repeats (CRISPR)-Cas nuclease. Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA, crRNA, crDNA, CRISPR array) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a effector protein/domain useful with this invention may be any known or later identified Cas12a polypeptide (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity, e.g., may have nickase activity.

In some embodiments, a CRISPR-Cas effector protein may be optimized for expression in an organism, for example, in an animal (e.g., a mammal such as a human), a plant, a fungus, an archaeon, or a bacterium. In some embodiments, a CRISPR-Cas effector protein (e.g., Cas12a polypeptide/domain or a Cas9 polypeptide/domain) may be optimized for expression in a plant.

An "adenine-modifying enzyme" as used herein refers to a polypeptide or domain thereof that catalyzes or is capable of catalyzing or modifying (e.g., mutating) an adenine base to a substrate for a glycosylase such as a damaged adenine base. In some embodiments, an adenine-modifying enzyme may modify an adenine (such as by damaging an adenine) thereby creating a substrate for a glycosylase and an abasic site may be generated from the substrate (e.g., damaged adenine). In some embodiments, an adenine-modifying enzyme may alkylate an adenine, oxidize an adenine, modify an adenine to hypoxanthine, and/or modify an adenine to inosine. Exemplary substrates for a glycosylase include, but are not limited to, alkylated adenines, adenines that are damaged by alkylation, oxidized adenines, and/or adenines that are damaged by oxidation. Exemplary damaged adenines include, but are not limited to, alkylated adenines, adenines that are damaged by alkylation, oxidized adenines, adenines that are damaged by oxidation, inosine, 3-methyladenine, hypoxanthine (Hx), 1,N$^6$-ethenoadenine (εA), and damaged adenines as described in Lee et al, *Biochemistry* 2009, 48, 1850-1861. An "abasic site" as used herein refers to an apurinic/apyrimidinic site and is a site or location in a nucleic acid that is devoid of a purine and devoid of a pyrimidine. In some embodiments, an adenine-modifying enzyme is an adenine deaminase such as an adenine deaminase as described herein.

Any deaminase domain/polypeptide useful for base editing may be used with this invention. A "cytosine deaminase" and "cytidine deaminase" as used herein refer to a polypeptide or domain thereof that catalyzes or is capable of catalyzing cytosine deamination in that the polypeptide or domain catalyzes or is capable of catalyzing the removal of an amine group from a cytosine base. Thus, a cytosine deaminase may result in conversion of cystosine to a thymidine (through a uracil intermediate), causing a C to T conversion, or a G to A conversion in the complementary strand in the genome. Thus, in some embodiments, the cytosine deaminase encoded by the polynucleotide of the invention generates a C→T conversion in the sense (e.g., "+"; template) strand of the target nucleic acid or a G→A conversion in antisense (e.g., "−", complementary) strand of the target nucleic acid. In some embodiments, a cytosine deaminase encoded by a polynucleotide of the invention generates a C to T, G, or A conversion in the complementary strand in the genome.

A cytosine deaminase useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). Cytosine deaminases can catalyze the hydrolytic deamination of cytidine or deoxycytidine to uridine or deoxyuridine, respectively. Thus, in some embodiments, a deaminase or deaminase domain useful with this invention may be a cytidine deaminase domain, catalyzing the hydrolytic deamination of cytosine to uracil. In some embodiments, a cytosine deaminase may be a variant of a naturally-occurring cytosine deaminase, including, but not limited to, a primate (e.g., a human, monkey, chimpanzee, gorilla), a dog, a cow, a rat or a mouse. Thus, in some embodiments, an cytosine deaminase useful with the invention may be about 70% to about 100% identical to a wild-type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring cytosine deaminase).

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBEC1, FERNY, and/or a CDA1, optionally a pmCDA1, an atCDA1 (e.g., At2g19570), and evolved versions of the same. Evolved deaminases are disclosed in, for example, U.S. Pat. No. 10,113,163, Gaudelli et al. Nature 551(7681):464-471 (2017)) and Thuronyi et al. (Nature Biotechnology 37: 1070-1079 (2019)), each of which are incorporated by reference herein for their disclosure of deaminases and evolved deaminases. In some embodiments, the cytosine deaminase may be an APOBEC1 deaminase having the amino acid sequence of SEQ ID NO:40. In some embodiments, the cytosine deaminase may be an APOBEC3A deaminase having the amino acid sequence of SEQ ID NO:41. In some embodiments, the cytosine deaminase may be an CDA1 deaminase, optionally a CDA1 having the amino acid sequence of SEQ ID NO:42. In some embodiments, the cytosine deaminase may be a FERNY deaminase, optionally a FERNY having the amino acid sequence of SEQ ID NO:43. In some embodiments, the cytosine deaminase may be a rAPOBEC1 deaminase, optionally a rAPOBEC1 deaminase having the amino acid sequence of SEQ ID NO:44. In some embodiments, the cytosine deaminase may be a hAID deaminase, optionally a hAID having the amino acid sequence of SEQ ID NO:45 or SEQ ID NO:46. In some embodiments, a cytosine deaminase useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase (e.g., "evolved deaminases") (see, e.g., SEQ ID NO:47, SEQ ID NO:48, SEQ ID NO:49). In some embodiments, a cytosine deaminase useful with the invention may be about 70% to about 99.5% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of any one of SEQ ID NOs:40-49 (e.g., at least 80%, at least 85%, at least 90%, at least 92%, at least 95%, at least 96%, at least 97%, at least 98%, at least 99%, or at least 99.5% identical to the amino acid sequence of any one of SEQ ID NOs:40-49). In some embodiments, a polynucleotide encoding a cytosine deaminase may be codon optimized for expression in a plant and the codon optimized polypeptide may be about 70% to 99.5% identical to the reference polynucleotide.

An "adenine deaminase" and "adenosine deaminase" as used herein refer to a polypeptide or domain thereof that catalyzes or is capable of catalyzing the hydrolytic deamination (e.g., removal of an amine group from adenine) of adenine or adenosine. In some embodiments, an adenine deaminase may catalyze the hydrolytic deamination of adenosine or deoxyadenosine to inosine or deoxyinosine, respectively. In some embodiments, the adenosine deaminase may catalyze the hydrolytic deamination of adenine or adenosine in DNA. In some embodiments, an adenine deaminase encoded by a nucleic acid construct of the invention may generate an A→G conversion in the sense (e.g., "+"; template) strand of the target nucleic acid or a T→C conversion in the antisense (e.g., "−", complementary) strand of the target nucleic acid. An adenine deaminase useful with this invention may be any known or later identified adenine deaminase from any organism (see, e.g., U.S. Pat. No. 10,113,163, which is incorporated by reference herein for its disclosure of adenine deaminases).

In some embodiments, an adenosine deaminase may be a variant of a naturally-occurring adenine deaminase. Thus, in some embodiments, an adenosine deaminase may be about 70% to 100% identical to a wild-type adenine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring adenine deaminase). In some embodiments, the deaminase or deaminase does not occur in nature and may be referred to as an engineered, mutated or evolved adenosine deaminase. Thus, for example, an engineered, mutated or evolved adenine deaminase polypeptide or an adenine deaminase domain may be about 70% to 99.9% identical to a naturally occurring adenine deaminase polypeptide/domain (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% identical, and any range or value therein, to a naturally occurring adenine deaminase polypeptide or adenine deaminase domain). In some embodiments, the adenosine deaminase may be from a bacterium, (e.g., *Escherichia coli, Staphylococcus aureus, Haemophilus influenzae, Caulobacter crescentus*, and the like). In some embodiments, a polynucleotide encoding an adenine deaminase polypeptide/domain may be codon optimized for expression in a plant.

In some embodiments, an adenine deaminase domain may be a wild-type tRNA-specific adenosine deaminase domain, e.g., a tRNA-specific adenosine deaminase (TadA) and/or a mutated/evolved adenosine deaminase domain, e.g., mutated/evolved tRNA-specific adenosine deaminase domain (TadA*). In some embodiments, a TadA domain may be from *E. coli*. In some embodiments, the TadA may be modified, e.g., truncated, missing one or more N-terminal and/or C-terminal amino acids relative to a full-length TadA (e.g., 1, 2, 3, 4, 5, 6, 7, 8, 9, 10, 11, 12, 13, 14, 15, 6, 17, 18, 19, or 20 N-terminal and/or C terminal amino acid residues may be missing relative to a full length TadA. In some embodiments, a TadA polypeptide or TadA domain does not comprise an N-terminal methionine. In some embodiments, a wild-type *E. coli* TadA comprises the amino acid sequence of SEQ ID NO:50. In some embodiments, a mutated/evolved *E. coli* TadA* comprises the amino acid sequence of SEQ ID NOs:51-54 (e.g., SEQ ID NOs: 51, 52, 53, or 54). In some embodiments, a polynucleotide encoding a TadA/TadA* may be codon optimized for expression in a plant. In some embodiments, an adenine deaminase may comprise all or a portion of an amino acid sequence of any one of SEQ ID NOs:55-60. In some embodiments, an adenine deaminase may comprise all or a portion of an amino acid sequence of any one of SEQ ID NOs:50-60.

In some embodiments, a nucleic acid construct of this invention may further encode a glycosylase inhibitor (e.g., a uracil glycosylase inhibitor (UGI) such as uracil-DNA glycosylase inhibitor). Thus, in some embodiments, a nucleic acid construct encoding a CRISPR-Cas effector protein and a cytosine deaminase and/or adenine deaminase may further encode a glycosylase inhibitor, optionally wherein the glycosylase inhibitor may be codon optimized for expression in a plant. In some embodiments, the invention provides fusion proteins comprising a CRISPR-Cas effector polypeptide and a UGI and/or one or more polynucleotides encoding the same, optionally wherein the one or more polynucleotides may be codon optimized for expression in a plant. In some embodiments, the invention provides fusion proteins comprising a CRISPR-Cas effector polypeptide, a deaminase domain (e.g., an adenine deaminase domain and/or a cytosine deaminase domain) and a UGI and/or one or more polynucleotides encoding the same, optionally wherein the one or more polynucleotides may be codon optimized for expression in a plant. In some embodiments, the invention provides fusion proteins, wherein a CRISPR-Cas effector polypeptide, a deaminase domain, and/or a UGI may be fused to any combination of peptide tags and affinity polypeptides as described herein, which may thereby recruit the deaminase domain and/or UGI to the CRISPR-Cas effector polypeptide and to a target nucleic acid. In some embodiments, a guide nucleic acid may be linked to a recruiting RNA motif and one or more of the deaminase domain and/or UGI may be fused to an affinity polypeptide that is capable of interacting with the recruiting RNA motif, thereby recruiting the deaminase domain and UGI to a target nucleic acid.

A "uracil glycosylase inhibitor" or "UGI" useful with the invention may be any protein or polypeptide or domain thereof that is capable of inhibiting a uracil-DNA glycosylase base-excision repair enzyme. In some embodiments, a UGI comprises a wild-type UGI or a fragment thereof. In some embodiments, a UGI useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical and any range or value therein) to the amino acid sequence of a naturally occurring UGI. In some embodiments, a UGI may comprise the amino acid sequence of SEQ ID NO:61 or a polypeptide having about 70% to about 99.5% identity to the amino acid sequence of SEQ ID NO:61 (e.g., at least 80%, at least 85%, at least 90%, at least 92%, at least 95%, at least 96%, at least 97%, at least 98%, at least 99%, or at least 99.5% identical to the amino acid sequence of SEQ ID NO:61). For example, in some embodiments, a UGI may comprise a fragment of the amino acid sequence of SEQ ID NO:61 that is 100% identical to a portion of consecutive nucleotides (e.g., 10, 15, 20, 25, 30, 35, 40, 45, 50, 55, 60, 65, 70, 75, 80 consecutive nucleotides; e.g., about 10, 15, 20, 25, 30, 35, 40, 45, to about 50, 55, 60, 65, 70, 75, 80 consecutive nucleotides) of the amino acid sequence of SEQ ID NO:61. In some embodiments, a UGI may be a variant of a known UGI (e.g., SEQ ID NO:61) having about 70% to about 99.5% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% identity, and any range or value therein) to the known UGI. In some embodiments, a polynucleotide encoding a UGI may be codon optimized for expression in a plant (e.g., a plant) and the codon optimized polypeptide may be about 70% to about 99.5% identical to the reference polynucleotide.

The nucleic acid constructs of the invention comprising a CRISPR-Cas effector protein or a fusion protein thereof may be used in combination with a guide nucleic acid (e.g., guide RNA (gRNA), CRISPR array, CRISPR RNA, crRNA), designed to function with the encoded CRISPR-Cas effector protein or domain thereof, to modify a target nucleic acid. A guide nucleic acid useful with this invention may comprise at least one spacer sequence and at least one repeat sequence. The guide nucleic acid is capable of forming a complex with the CRISPR-Cas nuclease domain encoded and expressed by a nucleic acid construct of the invention and the spacer sequence is capable of hybridizing to a target nucleic acid, thereby guiding the complex to the target nucleic acid, wherein the target nucleic acid may be modified (e.g., cleaved or edited) and/or modulated (e.g., modulating transcription) by a deaminase (e.g., a cytosine deaminase and/or adenine deaminase, optionally present in and/or recruited to the complex).

As an example, a nucleic acid construct encoding a Cas9 domain linked to a cytosine deaminase domain (e.g., a fusion protein) may be used in combination with a Cas9 guide nucleic acid to modify a target nucleic acid, wherein the cytosine deaminase domain of the fusion protein deaminates a cytosine base in the target nucleic acid, thereby editing the target nucleic acid. In a further example, a nucleic acid construct encoding a Cas9 domain linked to an adenine deaminase domain (e.g., a fusion protein) may be used in combination with a Cas9 guide nucleic acid to modify a target nucleic acid, wherein the adenine deaminase domain of the fusion protein deaminates an adenosine base in the target nucleic acid, thereby editing the target nucleic acid. In some embodiments, a CRISPR-Cas effector protein (e.g., Cas9) is not fused to a cytosine deaminase and/or adenine deaminase.

Likewise, a nucleic acid construct encoding a Cas12a domain (or other selected CRISPR-Cas nuclease, e.g., C2c1, C2c3, Cas12b, Cas12c, Cas12d, Cas12e, Cas13a, Cas13b, Cas13c, Cas13d, Casl, CaslB, Cas2, Cas3, Cas3', Cas3", Cas4, Cas5, Cas6, Cas7, Cas8, Cas9 (also known as Csnl and Csx12), Cas10, Csyl, Csy2, Csy3, Csel, Cse2, Cscl, Csc2, Csa5, Csn2, Csm2, Csm3, Csm4, Csm5, Csm6, Cmrl, Cmr3, Cmr4, Cmr5, Cmr6, Csbl, Csb2, Csb3, Csxl7, Csxl4, Csx10, Csx16, CsaX, Csx3, Csxl, Csxl5, Csfl, Csf2, Csf3, Csf4 (dinG), and/or Csf5) may be linked to a cytosine deaminase domain or adenine deaminase domain (e.g., fusion protein) and may be used in combination with a Cas12a guide nucleic acid (or the guide nucleic acid for the other selected CRISPR-Cas nuclease) to modify a target nucleic acid, wherein the cytosine deaminase domain or adenine deaminase domain of the fusion protein deaminates a cytosine base or adenosine base, respectively, in the target nucleic acid, thereby editing the target nucleic acid.

A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof, a repeat of a Type II Cas9 CRISPR-Cas system, or fragment thereof; a repeat of a Type V C2c1 CRISPR Cas system, or a fragment thereof, a repeat of a CRISPR-Cas system of, for example, C2c3, Cas12a (also referred to as Cpf1), Cas12b, Cas12c, Cas12d, Cas12e, Cas13a, Cas13b, Cas13c, Cas13d, Casl, CaslB, Cas2, Cas3, Cas3', Cas3", Cas4, Cas5, Cas6, Cas7, Cas8, Cas9 (also known as Csnl and Csx12), Cas10, Csyl, Csy2, Csy3, Csel, Cse2, Cscl, Csc2, Csa5, Csn2, Csm2, Csm3, Csm4, Csm5, Csm6, Cmrl, Cmr3, Cmr4, Cmr5, Cmr6, Csbl, Csb2, Csb3, Csxl7, Csxl4, Csx10, Csx16, CsaX, Csx3, Csxl, Csxl5, Csfl, Csf2, Csf3, Csf4 (dinG), and/or Csf5, or a fragment thereof), wherein the repeat sequence may be linked to the 5' end and/or the 3' end of the spacer sequence. In some embodiments, the guide nucleic acid comprises DNA. In some embodiments, the guide nucleic acid comprises RNA (e.g., is a guide RNA). The design of a gRNA of this invention may be based on a Type I, Type II, Type III, Type IV, Type V, or Type VI CRISPR-Cas system.

In some embodiments, a Cas12a gRNA may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (like in the MS2 recruitment strategy) or other RNA structures hanging off the spacer.

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas effector protein encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35(Web Server issue):W52-7). In some embodiments, a repeat sequence or portion thereof is linked at its 3' end to the 5' end of a spacer sequence, thereby forming a repeat-spacer sequence (e.g., guide nucleic acid, guide RNA/DNA, crRNA, crDNA).

In some embodiments, a repeat sequence comprises, consists essentially of, or consists of at least 10 nucleotides depending on the particular repeat and whether the guide nucleic acid comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein; e.g., about). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild-type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% sequence identity (e.g., at least about 90%, 91%, 92%, 93%, 94%, 95%, 96%, 97%, 98%, 99%, or more) to the same region (e.g., 5' end) of a wild-type CRISPR Cas repeat nucleotide sequence. In some embodiments, a portion of a repeat sequence may comprise a pseudoknot-like structure at its 5' end (e.g., "handle").

A "spacer sequence" as used herein is a nucleotide sequence that is complementary to a target nucleic acid (e.g., target DNA) (e.g, protospacer). The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 21, 22, or 23 nucleotides in length.

In some embodiments, the 5' region of a spacer sequence of a guide nucleic acid may be fully complementary to a target nucleic acid, while the 3' region of the spacer may be substantially complementary to the target nucleic acid (such as for a spacer in a Type V CRISPR-Cas system), or the 3' region of a spacer sequence of a guide nucleic acid may be fully complementary to a target nucleic acid, while the 5' region of the spacer may be substantially complementary to the target nucleic acid (such as for a spacer in a Type II CRISPR-Cas system), and therefore, the overall complementarity of the spacer sequence to the target nucleic acid may be less than 100%. Thus, for example, in a guide nucleic acid for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target nucleic acid, while the remaining nucleotides in the 3' region of the spacer sequence are substantially complementary (e.g., at least about 70% complementary) to the target nucleic acid. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target nucleic acid, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target nucleic acid.

As a further example, in a guide nucleic acid for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target nucleic acid, while the remaining nucleotides in the 5' region of the spacer sequence are substantially complementary (e.g., at least about 70% complementary) to the target nucleic acid. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target nucleic acid, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 8100, 82%, 83%, 84%, 85%, 86%, 87%, 88%, 89%, 90%, 91%, 92%, 93%, 94%, 95%, 96%, 97%, 98%, 99%, or more or any range or value therein)) to the target nucleic acid. In some embodiments, a seed region of a spacer may be about 8 to about 10 nucleotides in length, about 5 to about 6 nucleotides in length, or about 6 nucleotides in length.

As used herein, a "target nucleic acid", "target DNA," "target nucleotide sequence," "target region," or a "target region in the genome" refer to a region of an organism's (e.g., a plant's) genome that comprises a sequence that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide nucleic acid as defined herein. A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome or mammalian (e.g., human) genome). A target region may be selected from any region of at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence.

A "protospacer sequence" or "protospacer" as used herein refer to a sequence that is fully or substantially complementary to (and can hybridize to) a spacer sequence of a guide nucleic acid. In some embodiments, the protospacer is all or a portion of a target nucleic acid as defined herein that is fully or substantially complementary (and hybridizes) to the spacer sequence of the CRISPR repeat-spacer sequences (e.g., guide nucleic acids, CRISPR arrays, crRNAs).

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

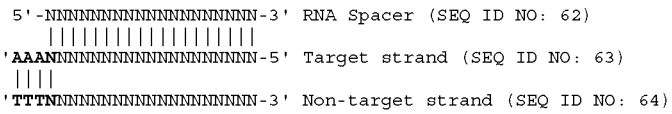

```
5'-NNNNNNNNNNNNNNNNNNNN-3'  RNA Spacer (SEQ ID NO: 62)
   ||||||||||||||||||||
3'AAANNNNNNNNNNNNNNNNNNNN-5' Target strand (SEQ ID NO: 63)
   ||||
5'TTTNNNNNNNNNNNNNNNNNNNN-3' Non-target strand (SEQ ID NO: 64)
```

In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5'-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

In some embodiments, the present invention provides expression cassettes and/or vectors comprising the nucleic acid constructs of the invention (e.g., one or more components of an editing system of the invention). In some embodiments, expression cassettes and/or vectors comprising the nucleic acid constructs of the invention and/or one or more guide nucleic acids may be provided. In some embodiments, a nucleic acid construct of the invention encoding a base editor (e.g., a construct comprising a CRISPR-Cas effector protein and a deaminase domain (e.g., a fusion protein)) or the components for base editing (e.g., a CRISPR-Cas effector protein fused to a peptide tag or an affinity polypeptide, a deaminase domain fused to a peptide tag or an affinity polypeptide, and/or a UGI fused to a peptide tag or an affinity polypeptide), may be comprised on the same or on a separate expression cassette or vector from that comprising the one or more guide nucleic acids. When the nucleic acid construct encoding a base editor or the components for base editing is/are comprised on separate expression cassette(s) or vector(s) from that comprising the guide nucleic acid, a target nucleic acid may be contacted with (e.g., provided with) the expression cassette(s) or vector(s) encoding the base editor or components for base editing in any order from one another and the guide nucleic acid, e.g., prior to, concurrently with, or after the expression cassette comprising the guide nucleic acid is provided (e.g., contacted with the target nucleic acid).

Fusion proteins of the invention may comprise a sequence-specific DNA binding domain, a CRISPR-Cas effector protein, and/or a deaminase fused to a peptide tag or an affinity polypeptide that interacts with the peptide tag, as known in the art, for use in recruiting the deaminase to the target nucleic acid. Methods of recruiting may also comprise a guide nucleic acids linked to an RNA recruiting motif and a deaminase fused to an affinity polypeptide capable of interacting with the RNA recruiting motif, thereby recruiting the deaminase to the target nucleic acid. Alternatively, chemical interactions may be used to recruit a polypeptide (e.g., a deaminase) to a target nucleic acid.

As described herein, a "peptide tag" may be employed to recruit one or more polypeptides. A peptide tag may be any polypeptide that is capable of being bound by a corresponding affinity polypeptide. A peptide tag may also be referred to as an "epitope" and when provided in multiple copies, a "multimerized epitope." Example peptide tags can include, but are not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. In some embodiments, a peptide tag may also include phosphorylated tyrosines in specific sequence contexts recognized by SH2 domains, characteristic consensus sequences containing phosphoserines recognized by 14-3-3 proteins, proline rich peptide motifs recognized by SH3 domains, PDZ protein interaction domains or the PDZ signal sequences, and an AGO hook motif from plants. Peptide tags are disclosed in WO2018/136783 and U.S. Patent Application Publication No. 2017/0219596, which are incorporated by reference for their disclosures of peptide tags. Peptide tags that may be useful with this invention can include, but are not limited to, SEQ ID NO: 65 and SEQ ID NO:66. An affinity polypeptide useful with peptide tags includes, but is not limited to, SEQ ID NO:67.

Any epitope that may be linked to a polypeptide and for which there is a corresponding affinity polypeptide that may be linked to another polypeptide may be used with this invention as a peptide tag. In some embodiments, a peptide tag may comprise 1 or 2 or more copies of a peptide tag (e.g., repeat unit, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more repeat units. In some embodiments, an affinity polypeptide that interacts with/binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26(5):910-924 (2017)); Gilbreth (*Curr Opin Struc Biol* 22(4):413-420 (2013)), U.S. Pat. No. 9,982,053, each of which are incorporated by reference in their entireties for the teachings relevant to affibodies, anticalins, monobodies and/or DARPins.

In some embodiments, a guide nucleic acid may be linked to an RNA recruiting motif, and a polypeptide to be recruited (e.g., a deaminase) may be fused to an affinity polypeptide that binds to the RNA recruiting motif, wherein the guide binds to the target nucleic acid and the RNA recruiting motif binds to the affinity polypeptide, thereby recruiting the polypeptide to the guide and contacting the target nucleic acid with the polypeptide (e.g., deaminase). In some embodiments, two or more polypeptides may be recruited to a guide nucleic acid, thereby contacting the target nucleic acid with two or more polypeptides (e.g., deaminases).

In some embodiments of the invention, a guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs. In some embodiments, an RNA recruiting motif and corresponding affinity polypeptide may include, but is not limited to, a telomerase Ku binding motif (e.g., Ku binding hairpin) and an affinity polypeptide of Ku (e.g., Ku heterodimer), a telomerase Sm7 binding motif and an affinity polypeptide of Sm7, an MS2 phage operator stem-loop and an affinity polypeptide of MS2 Coat Protein (MCP), a PP7 phage operator stem-loop and an affinity polypeptide of PP7 Coat Protein (PCP), an SfMu phage Com stem-loop and an affinity polypeptide of Com RNA binding protein, a PUF binding site (PBS) and an affinity polypeptide of Pumilio/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide Pumilio/fem-3 mRNA binding factor (PUF). Exemplary RNA recruiting motifs and corresponding affinity polypeptides that may be useful with this invention can include, but are not limited to, SEQ ID NOs:68-78.

In some embodiments, the components for recruiting polypeptides and nucleic acids may include those that function through chemical interactions that may include, but are not limited to, rapamycin-inducible dimerization of FRB-FKBP; Biotin-streptavidin; SNAP tag; Halo tag; CLIP tag; DmrA-DmrC heterodimer induced by a compound; bifunctional ligand (e.g., fusion of two protein-binding chemicals together; e.g. dihyrofolate reductase (DHFR).

A peptide tag may comprise or be present in one copy or in 2 or more copies of the peptide tag (e.g., multimerized peptide tag or multimerized epitope) (e.g., about 2, 3, 4, 5, 6, 7, 8, 9, 10, 11, 12, 13, 14, 15, 16, 17, 18, 9, 20, 21, 22, 23, 24, or 25 or more peptide tags). When multimerized, the peptide tags may be fused directly to one another or they may be linked to one another via one or more amino acids (e.g., 1, 2, 3, 4, 5, 6, 7, 8, 9, 10, 11, 12, 13, 14, 15, 16, 17, 18, 19, 20 or more amino acids, optionally about 3 to about 10, about 4 to about 10, about 5 to about 10, about 5 to about 15, or about 5 to about 20 amino acids, and the like, and any value or range therein. Thus, in some embodiments, a CRISPR-Cas effector protein of the invention may comprise a CRISPR-Cas effector protein domain fused to one peptide tag or to two or more peptide tags, optionally wherein the two or more peptide tags are fused to one another via one or more amino acid residues. In some embodiments, a peptide tag useful with the invention may be a single copy of a GCN4 peptide tag or epitope or may be a multimerized GCN4 epitope comprising about 2 to about 25 or more copies of the peptide tag (e.g., about 2, 3, 4, 5, 6, 7, 8, 9, 10, 11, 12, 13, 14, 15, 16, 17, 18, 19, 20, 21, 22, 23, 24, 25 or more copies of a GCN4 epitope or any range therein).

In some embodiments, a peptide tag may be fused to a CRISPR-Cas polypeptide or domain. In some embodiments, a peptide tag may be fused or linked to the C-terminus of a CRISPR-Cas effector protein to form a CRISPR-Cas fusion protein. In some embodiments, a peptide tag may be fused or linked to the N-terminus of a CRISPR-Cas effector protein to form a CRISPR-Cas fusion protein. In some embodiments, a peptide tag may be fused within a CRISPR-Cas effector protein (e.g., a peptide tag may be in a loop region of a CRISPR-Cas effector protein). In some embodiments, peptide tag may be fused to a cytosine deaminase and/or to an adenine deaminase.

In some embodiments, when a peptide tag comprises more than one peptide tag, the quantity and spacing of each peptide tag may be optimized to maximize occupation of the peptide tags and minimize steric interference of, for example, deaminase domains, with each other.

An "affinity polypeptide" (e.g., "recruiting polypeptide") refers to any polypeptide that is capable of binding to its corresponding peptide tag, peptide tag, or RNA recruiting motif. An affinity polypeptide for a peptide tag may be, for example, an antibody and/or a single chain antibody that specifically binds the peptide tag, respectively. In some embodiments, an antibody for a peptide tag may be, but is not limited to, an scFv antibody. In some embodiments, an affinity polypeptide may be fused or linked to the N-terminus of a deaminase (e.g., a cytosine deaminase or an adenine deaminase). In some embodiments, the affinity polypeptide is stable under the reducing conditions of a cell or cellular extract.

The nucleic acid constructs of the invention and/or guide nucleic acids may be comprised in one or more expression cassettes as described herein. In some embodiments, a nucleic acid construct of the invention may be comprised in the same or in a separate expression cassette or vector from that comprising a guide nucleic acid and/or a recruiting guide nucleic acid.

When used in combination with guide nucleic acids and recruiting guide nucleic acids, the nucleic acid constructs of the invention (and expression cassettes and vectors comprising the same) may be used to modify a target nucleic acid and/or its expression. A target nucleic acid may be contacted with a nucleic acid construct of the invention and/or expression cassettes and/or vectors comprising the same prior to, concurrently with or after contacting the target nucleic acid with the guide nucleic acid/recruiting guide nucleic acid (and/or expression cassettes and vectors comprising the same.

The present invention further provides methods for modifying a target nucleic acid using a nucleic acid construct of the invention, and/or an expression cassette and/or vector comprising the same. The methods may be carried out in an in vivo system (e.g., in a cell or in an organism) or in an in vitro system (e.g., cell free). A method, composition, and/or system of the present invention may generate and/or provide allelic diversity, optionally in a semi-random way. In some embodiments, a method of the present invention comprises determining a desired or preferred phenotype using and/or based on the modified target nucleic acid. A method of the present invention may provide one or more modified target nucleic acid(s), and the one or more modified target nucleic acid(s) may be analyzed for a desired or preferred phenotype.

In some embodiments, the invention provides a method of modifying a target nucleic acid, the method comprising: contacting the target nucleic acid with: a CRISPR-Cas effector protein (e.g., a CRISPR enzyme), a guide nucleic acid (e.g., a guide RNA), an adenine-modifying enzyme (e.g., an adenine deaminase), and a glycosylase, thereby modifying the target nucleic acid. The method may further comprise glycosylating a damaged adenine (e.g., an alkylated adenine, oxidized adenine, and/or inosine) present in the target nucleic acid. The CRISPR-Cas effector protein, the adenine-modifying enzyme, the guide nucleic acid and/or the glycosylase may form a complex or may be comprised in a complex. In some embodiments, the modifying of the target nucleic acid is without nucleic acid cleavage (i.e., the modifying of the target nucleic acid does not include or is devoid of cleavage of the target nucleic acid) and/or the method is devoid of cleavage of a nucleic acid.

According to some embodiments, a method of glycosylating a damaged adenine (e.g., an alkylated adenine, oxidized adenine, and/or inosine) present in a target nucleic acid is provided, the method comprising: contacting the target nucleic acid with: a CRISPR-Cas effector protein (e.g., a CRISPR enzyme), a guide nucleic acid (e.g., a guide RNA), an adenine-modifying enzyme, and a glycosylase; and glycosylating the damaged adenine, optionally using the glycosylase. The method of glycoslating the damaged adenine may further comprise generating the damaged adenine in the target nucleic acid, optionally using the CRISPR-Cas effector protein, guide nucleic acid and/or adenine-modifying enzyme. The CRISPR-Cas effector protein, the adenine-modifying enzyme, the guide nucleic acid and/or the glycosylase may form a complex or may be comprised in a complex. In some embodiments, the glycosylating of the damaged adenine is without nucleic acid cleavage (i.e., the glycosylating of the damaged adenine does not include or is devoid of cleavage of the target nucleic acid) and/or the method is devoid of cleavage of a nucleic acid.

In some embodiments, a method of diversifying a target nucleic acid is provided, the method comprising: contacting the target nucleic acid with: a CRISPR-Cas effector protein (e.g., a CRISPR enzyme), a guide nucleic acid (e.g., a guide RNA), an adenine-modifying enzyme (e.g., an adenine deaminase), and a glycosylase, thereby diversifying the target nucleic acid. In some embodiments, diversifying the target nucleic acid comprises modifying an adenine (A) in the target nucleic acid to a cytosine (C), a thymine (T), or a guanine (G). The method of diversifying the target nucleic acid may further comprise screening a cell or organism in which the target nucleic acid is present, optionally for a given phenotype. In some embodiments, the screening comprises performing molecular screening on the cell or organism. In some embodiments, the screening comprises analyzing the DNA of the cell or organism after the contacting step. In some embodiments, the screening comprises screening a plant in which the target nucleic acid is present for a given phenotype. In some embodiments, the screening comprises phenotyping and/or performing molecular screening on a cell or organism (e.g., plant) in which the target nucleic acid is present. Methods of screening are known to those of skill in the art and include, but are not limited to, evaluating gene expression levels such as by using quantitative PCR (qPCT) and/or by physical and/or visual evaluation of the phenotype.

A method of the present invention that comprises contacting a target nucleic acid with a CRISPR-Cas effector protein (e.g., a CRISPR enzyme), a guide nucleic acid (e.g., a guide RNA), an adenine-modifying enzyme, and a glycosylase may modify an adenine (A) of the target nucleic acid to a cytosine (C), a thymine (T), or a guanine (G). In some embodiments, the method modifies an A to a C or T, optionally at an increased rate compared to the rate of an A to C or T modification in the absence of contacting the target nucleic acid with a CRISPR-Cas effector protein, a guide nucleic acid, an adenine-modifying enzyme, and a glycosylase and/or in the absence of contacting the target nucleic acid with a glycosylase. In some embodiments, the method modifies an A to a C or T at a rate that is about 1/5 to about 1/20 that of the rate of an A to G modification produced according to the method. In some embodiments, the method modifies one or more adenines to provide diversity in the target nucleic acid, and the method may modify one or more adenines to a cytosine, thymine, and/or guanine. For example, the method may modify a first adenine (A) of the target nucleic acid to a cytosine (C), a second adenine (A) of the target nucleic acid to a thymine (T), and/or a third adenine (A) of the target nucleic acid to a guanine (G).

In some embodiments, the method that comprises contacting a target nucleic acid with a CRISPR-Cas effector protein, a guide nucleic acid, an adenine-modifying enzyme, and a glycosylase may comprise modifying a thymine (T) of the target nucleic acid to a cytosine (C), an adenine (A), or a guanine (G). To modify the thymine of the target nucleic acid, the complement adenine (A) in the complement strand of the target nucleic acid for the thymine may be modified to a C, T, or G and, upon replication, the T may be modified to the complement. For example, to modify a T to a C in a target nucleic acid, the complement A in the complement strand for the T in the target nucleic acid may be modified to a G (i.e., A to G in the complement strand), and then, upon replication, the T is modified to a C since C is the complement of the G in the modified complement strand.

A "glycosylase" as used herein in a method, composition, or system along with an adenine-modifying enzyme refers to a polypeptide or domain thereof that recognizes a damaged adenine (e.g., an alkylated adenine, an oxidized adenine, hypoxanthine, and/or inosine) and can or is capable of generating an abasic site from the damage adenine. A glycosylase present and/or used in a composition, method, and/or system of the present invention may recognize a damaged adenine, hydrolyze a N-glycosylic bond, and generate an abasic site from the damaged adenine. Exemplary glycosylases include, but are not limited to, DNA glycosylases such as 3-methyladenine DNA glycosylase, RNA glycosylases, methylpurine glycosylases (MPG), thymine DNA glycosylases such as a thymine DNA glycosylase homolog from *Schizosaccharomyces pombe* (SpThp1) (e.g., as described in Hardeland, et al., *Nucleic Acid Research*, 2003 May 1; 31(9): 2261-2271 and Alseth et al. *Nucleic Acid Research*, 2005; 33(3): 1123-1131), adenine DNA glycosylases, uracil DNA glycosylases such as hypoxanthine DNA glycosylase (HDG) (e.g., as described in Lee, et al., *Biol. Chem.* 2011 Sep. 9; 286(36): 31282-31287), and/or glycosylases as described in Brooks et al, *Biochimica et Biophysica Acta (BBA)—Proteins and Proteomics* Vol. 1834, Issue 1, January 2013, p. 247-271, Saparbaev et al., *Nucleic Acids Research*, Vol. 28, Issue 6, 15 Mar. 2000, p. 1332-1339, Miao, et al., *Nucleic Acid Research*, 1998 Sep. 1; 26(17): 4034-4041.

The glycosylase present and/or used in a composition, method, and/or system of the present invention may be from any species such as human 3-methyladenine DNA glycosylase (AAG), methyladenine DNA glycosylase II (AlkA) from *Escherichia coli*, methyladenine DNA glycosylase from rat (APDG protein), and/or methyladenine DNA glycosylase from yeast (MAG protein) and/or may be a homolog thereof. In some embodiments, the glycosylase recognizes hypoxanthine such as hypoxanthine in the target nucleic acid. In some embodiments, the glycosylase is an inosine glycosylase. In some embodiments, the glycosylase comprises the catalytic domain capable of generating an abasic site and/or excising an inosine. In some embodiments, a glycosylase may comprise all or a portion of an amino acid sequence of any one of SEQ ID NOs:79-91 or 146-276. In some embodiments, a glycosylase comprises an amino acid sequence having at least 70%, 75%, 80%, 85%, 90%, 95%, 96%, 97%, 98%, 99%, or more sequence identity to any one of SEQ ID NOs:79-91 or 146-276.

In some embodiments, the CRISPR-Cas effector protein is linked (e.g., fused) to the adenine-modifying enzyme and/or the glycosylase. The CRISPR-Cas effector protein, adenine-modifying enzyme, and/or the glycosylase may be linked using methods known in the art. In some embodiments, the CRISPR-Cas effector protein, adenine-modifying enzyme, and/or the glycosylase may be linked via a peptide linker, optionally wherein the peptide linker has one of the amino acid sequences of SEQ ID NOs:92-122. In some embodiments, the peptide linker may be a GS linker. In some embodiments, the peptide linker may comprise an amino acid sequence of $(GGS)_n$, $S(GGS)_n$ (SEQ ID NO:116), or SGGS (SEQ ID NO:117), wherein n is an integer of 1-20 (e.g., 1, 2, 3, 4, 5, 6, 7, 8, 9, 10, 11, 12, 13, 14, 15, 16, 17, 18, 19, or 20). In some embodiments, the peptide linker may comprise the amino acid sequence: SGGSGGSGGS (SEQ ID NO:119). In some embodiments, the peptide linker may comprise the amino acid sequence: SGSETPGTSESATPES (SEQ ID NO:119), also referred to as the XTEN linker. In some embodiments, the peptide linker may comprise the amino acid sequence: SGGSSGGSSGSETPGTSESATPESSGGSSGGS (SEQ ID NO:120), also referred to as the GS-XTEN-GS linker. In some embodiments, the adenine-modifying enzyme is linked to the glycosylase (e.g., linked using a peptide linker), optionally wherein the glycosylase is linked at the C-terminus of the adenine-modifying enzyme. In some embodiments, the adenine-modifying enzyme is linked to the CRISPR-Cas effector protein (e.g., linked using a peptide linker). Exemplary fusion proteins including the CRISPR-Cas effector protein, the adenine-modifying enzyme and the glycosylase include, but are not limited to, a fusion protein comprising all or a portion of an amino acid sequence of any one of an amino acid sequence of any one of SEQ ID NOs:123-128.

The glycosylase may be overexpressed in a cell in which it is present. In some embodiments, the glycosylase is an exogenous glycosylase. In some embodiments, the glycosylase is a native glycosylase. Overexpression of the glycosylase in the cell in which it is present may provide sufficient glycosylase to interact with the CRISPR-Cas effector protein, adenine-modifying enzyme, guide nucleic acid, and/or target nucleic acid and thereby generate an abasic site in the target nucleic acid present in the cell.

In some embodiments, the glycosylase is recruited to the target nucleic acid using methods, moieties, and/or compounds as described herein. For example, in some embodiments, the glycosylase is recruited to the target nucleic acid via the CRISPR-Cas effector protein and/or via the adenine-modifying enzyme. In some embodiments, the glycosylase may be recruited to the target nucleic acid and may provide a single complex with the CRISPR-Cas effector protein. In some embodiments, the glycosylase may be recruited to the target nucleic acid in a manner that is the same as that described herein for a cytosine deaminase or adenine deaminase.

In some embodiments, the glycosylase is recruited to the target nucleic acid using an affinity polypeptide such as an affinity polypeptide as described herein. For example, the CRISPR-Cas effector protein and/or the adenine-modifying enzyme may comprise a peptide tag (e.g., a SunTag), and the glycosylase may comprise an affinity polypeptide (e.g., an scFv) capable of binding the peptide tag. The peptide tag may comprise one or more (e.g., 1, 2, 3, 4, or more) GCN4 epitope(s). The glycosylase and the affinity polypeptide may be linked together. Thus, the interaction and/or binding of the affinity polypeptide and peptide tag may cause the glycosylase to be recruited to the target nucleic acid.

In some embodiments, the glycosylase is recruited to the target nucleic acid using a peptide tag such as a peptide tag as described herein. For example, the glycosylase may comprise a peptide tag (e.g., a SunTag) and the CRISPR-Cas effector protein and/or the adenine-modifying enzyme may comprise an affinity polypeptide (e.g., an scFv) capable of binding the peptide tag. The affinity polypeptide is linked to the CRISPR-Cas effector protein and/or adenine-modifying enzyme, and the peptide tag may comprise one or more (e.g., 1, 2, 3, 4, or more) GCN4 epitope(s). Thus, the interaction and/or binding of the affinity polypeptide and peptide tag may cause the glycosylase to be recruited to the target nucleic acid.

In some embodiments, the glycosylase is recruited to the target nucleic acid using the guide nucleic acid. For example, the guide nucleic acid may comprise a RNA recruiting motif such as a RNA recruiting motif as described herein and the glycosylase and/or adenine-modifying enzyme may comprise a moiety that binds to the RNA recruiting motif. In some embodiments, the RNA recruiting motif is a MS2 hairpin and the glycosylase and/or adenine-modifying enzyme comprise a MS2 capping protein (MCP) or a portion thereof (e.g., the glycosylase and/or adenine-modifying enzyme and the MCP or portion thereof may be linked together). The MCP protein or portion thereof may bind to the RNA recruiting motif (e.g., MS2 hairpin), thereby recruiting the glycosylase to the target nucleic acid.

In some embodiments, the CRISPR-Cas effector protein and/or the adenine-modifying enzyme may comprise a peptide tag (e.g., a SunTag), the glycosylase may comprise an affinity polypeptide (e.g., an scFv) capable of binding the peptide tag, and the guide nucleic acid may comprise a RNA recruiting motif (e.g., a MS2 hairpin). The peptide tag (e.g., Sun Tag) may be recruited to the RNA recruiting motif (e.g., MS2 hairpin) and the glycosylase may be recruited to the peptide tag using the affinity polypeptide.

In some embodiments, the invention provides a method of modifying a target nucleic acid, the method comprising contacting the target nucleic acid with: a CRISPR-Cas effector protein (e.g., a CRISPR enzyme), a guide nucleic acid (e.g., a guide RNA), a cytosine deaminase, and an adenine deaminase, wherein the CRISPR-Cas effector protein and the cytosine deaminase and/or the adenine deaminase form a complex or are comprised in a complex. In some embodiments, the CRISPR-Cas effector protein comprises the guide nucleic acid or the complex further comprises the guide nucleic acid. The cytosine deaminase and adenine deaminase may be fused together and/or one or both of the cytosine deaminase and adenine deaminase may be fused to the CRISPR-Cas effector protein. In some embodiments, the cytosine deaminase and the adenine deaminase are not simultaneously in the complex, but may each be separately present in the complex with the CRISPR-Cas effector protein in a short period of time and/or in succession. In some embodiments, the cytosine deaminase and the CRISPR-Cas effector protein are in a first complex and the adenine deaminase and the CRISPR-Cas effector protein are in a second complex, optionally wherein the first and second complexes include the same or a different guide nucleic acid. In some embodiments, the cytosine deaminase and/or adenine deaminase is/are not fused to a Cas9. In some embodiments, the CRISPR-Cas effector protein is a Type V CRISPR-Cas effector protein (e.g., Cpf1). In some embodiments, the target nucleic acid is in a non-coding region of a gene such as a promoter region and/or in a coding region of a gene.

In some embodiments, a method of the present invention and/or a complex comprising a CRISPR-Cas effector protein, cytosine deaminase, and/or adenine deaminase may concurrently and/or simultaneously modify the target nucleic acid in that a single delivery of reagents comprising the CRISPR-Cas effector protein, cytosine deaminase, and adenine deaminase may provide for and/or cause a cytidine and adenine base present in the target nucleic acid to be modified (e.g., C to T and A to G). The concurrent and/or simultaneous modifying of the target nucleic acid may occur in a time period corresponding to a single delivery of reagents that are sufficient to result in both types of editing (i.e., C to T and A to G). In some embodiments, the editing of C to T and A to G occurs within a period of time starting from the delivery of the reagents to a cell, tissue, and/or organism to the time the cell, tissue, and/or organism is screened for editing, with there only being a single delivery of reagents to the cell, tissue, and/or organism. The method and/or single delivery may further comprise a glycosylase inhibitor (e.g., UGI) and/or a MCP or portion thereof, optionally comprising a peptide tag. In some embodiments, the cytosine deaminase and the adenine deaminase are both recruited to the target nucleic acid and provide a single complex with the CRISPR-Cas effector protein. The cytosine deaminase and the adenine deaminase may each be recruited to the CRISPR-Cas effector protein using the same or a different recruitment strategy such as those described herein.

A method of the present invention and/or a complex comprising a CRISPR-Cas effector protein, cytosine deaminase, and adenine deaminase may provide and/or result in an increased number of alleles compared to current methods of mutagenesis such as Cas9-mediated mutagenesis (e.g. Cas9-mediated mutagenesis of a promotor, TadA fusion to the N-terminus of Cas9, and/or pmCDA1 fusion to the C-terminus of Cas9). In some embodiments, a method of the present invention and/or a complex comprising a CRISPR-Cas effector protein, cytosine deaminase, and adenine deaminase may provide and/or result in 2 or more (e.g., 2, 3, 4, 5, 6, 7, 8, 9, 10, 20, or more) different modified target nucleic acids per target nucleic acid site.

In some embodiments, an RNA recruiting motif may be used to recruit the cytosine deaminase and/or the adenine deaminase. In some embodiments, the guide nucleic acid comprises a RNA recruiting motif as described herein, optionally wherein the RNA recruiting motif is a MS2 hairpin. The cytosine deaminase and/or the adenine deaminase may comprise the corresponding affinity polypeptide for the RNA recruiting motif such as a MCP or portion thereof. A glycosylase inhibitor (e.g., UGI) as described herein may be fused to the CRISPR-Cas effector protein, cytosine deaminase, and/or adenine deaminase. In some embodiments, a glycosylase inhibitor is provided in trans. "In trans" as used herein refers to the expression of a component (e.g., a compound such as a glycosylase inhibitor) separately from a CRISPR-Cas effector protein and deaminase, optionally in the same cassette using its own promoter or using a separate expression cassette in a cell. For example, in some embodiments, a guide RNA comprises at least one MS2 hairpin, and a MS2 capping protein (MCP) or a portion thereof, which binds to the MS2 hairpin, is fused to the adenine and cytidine deaminases either separately or as a single fusion. A glycosylase inhibitor (e.g., UGI) may be provided as a fusion as described herein or in trans. Accordingly, the adenine and cytidine deaminases may be recruited, optionally simultaneously, to the guide RNA and/or to the target nucleic acid and may perform C to T and A to G editing within the deamination time frame and/or deamination window (e.g., a sub-sequence in target nucleic acid where base editing is typically observed).

In some embodiments, the CRISPR-Cas effector protein may be fused to the cytosine deaminase and/or the adenine deaminase. For example, in some embodiments, one of the cytosine deaminase and the adenine deaminase are fused to the CRISPR-Cas effector protein and the other is recruited to the using a recruitment strategy such as a RNA recruiting motif.

In some embodiments, the CRISPR-Cas effector protein is fused to the cytosine deaminase and the adenine deaminase is recruited to the complex via an RNA recruiting motif such as a MS2 hairpin. For example, the adenine deaminase may comprise a (MCP) or a portion thereof (e.g., the adenine deaminase and the MCP or portion thereof may be fused together) as the MCP or portion thereof is capable of and/or binds to the MS2 hairpin. In some embodiments, the CRISPR-Cas effector protein is fused to the adenine deaminase and the cytosine deaminase is recruited to the complex via an RNA recruiting motif such as a MS2 hairpin. For example, the cytosine deaminase may comprise a (MCP) or a portion thereof (e.g., the cytosine deaminase and the MCP or portion thereof may be fused together) as the MCP or portion thereof is capable of and/or binds to the MS2 hairpin.

In some embodiments, the CRISPR-Cas effector protein comprises a peptide tag as described herein. The peptide tag may be a SunTag and/or may comprise one or more (e.g., 1, 2, 3, 4, or more) GCN4 epitope(s). The adenine deaminase and/or cytosine deaminase may comprise an affinity polypeptide as described herein (e.g., an scFv) that is capable of binding the peptide tag. In some embodiments, the adenine deaminase and/or cytosine deaminase and the affinity polypeptide are fused together. Thus, the cytosine deaminase and/or adenine deaminase may be recruited to the CRISPR-Cas effector protein and/or the target nucleic acid using the affinity polypeptide. For example, the N- or C-terminus of the CRISPR-Cas effector protein may be fused to a SunTag, which contains multiples of GCN4 epitope, and a scFv that recognizes GCN4 may be fused to the adenine deaminase and/or and cytosine deaminase either separately or as a single fusion. A glycosylase inhibitor (e.g., UGI) may be provided as a fusion or in trans. The adenine deaminase and cytosine deaminase can be recruited, optionally simultaneously, to the target nucleic acid and may perform C and A editing within the deamination time frame and/or deamination window (e.g., a sub-sequence in target nucleic acid where base editing is typically observed).

In some embodiments, the CRISPR-Cas effector protein comprises a peptide tag as described herein and the CRISPR-Cas effector protein is fused to the adenine deaminase and/or cytosine deaminase. The peptide tag may be a SunTag and/or may comprise one or more (e.g., 1, 2, 3, 4, or more) GCN4 epitope(s). In some embodiments, one of the adenine deaminase and cytosine deaminase is fused to the CRISPR-Cas effector protein and the other of the adenine deaminase and cytosine deaminase comprises an affinity polypeptide as described herein (e.g., an scFv) that is capable of binding the peptide tag. Thus, one of the cytosine deaminase and adenine deaminase may be recruited to the CRISPR-Cas effector protein and/or the target nucleic acid using the affinity polypeptide. For example, the N- or C-terminus of the CRISPR-Cas effector protein may be fused to a SunTag, which contains multiples of GCN4 epitope, and the other terminus may be fused to an adenine deaminase domain or a cytosine deaminase domain, and a scFv that recognizes GCN4 may be fused to an adenine deaminase or cytosine deaminase depending on which is fused to the CRISPR-Cas effector protein. A glycosylase inhibitor (e.g., UGI) may be provided as a fusion or in trans.

In some embodiments, the adenine deaminase and/or cytosine deaminase may comprise a peptide tag. The peptide tag may be a SunTag and/or may comprise one or more (e.g., 1, 2, 3, 4, or more) GCN4 epitope(s). In some embodiments, the adenine deaminase and/or cytosine deaminase and/or the peptide tag may be fused together. The CRISPR-Cas effector protein may comprise an affinity polypeptide (e.g., an scFv) that is capable of binding the peptide tag, optionally wherein the CRISPR-Cas effector protein and the affinity polypeptide are fused together. Thus, the CRISPR-Cas effector protein may be recruited to the adenine deaminase and/or cytosine deaminase and/or the target nucleic acid using the affinity polypeptide. A glycosylase inhibitor (e.g., UGI) may be provided as a fusion or in trans.

In some embodiments, the CRISPR-Cas effector protein may comprise a guide nucleic acid (e.g., a guide RNA) that comprises a RNA recruiting motif. For example, the CRISPR-Cas effector protein may be fused to a guide RNA that comprises an RNA recruiting motif, optionally wherein the guide RNA is fused to the RNA recruiting motif. In some embodiments, guide RNA may comprise one or more MS2 hairpins. The corresponding affinity polypeptide for the RNA recruiting motif, such as a MCP or portion thereof, may comprise a peptide tag as described herein and the corresponding affinity polypeptide may present during the contacting step and/or may also be contacted to the target nucleic acid. The cytosine deaminase and/or adenine deaminase may comprise an affinity polypeptide (e.g., an scFv) that is capable of binding the peptide tag, optionally wherein cytosine deaminase and/or adenine deaminase and the affinity polypeptide are fused together. In some embodiments, the cytosine deaminase and adenine deaminase are each separately be fused to an affinity polypeptide that may be the same or different. In some embodiments, the cytosine deaminase, the adenine deaminase, and an affinity polypeptide are fused together. In some embodiments, an MCP or portion thereof that comprises a peptide tag (e.g., a SunTag) may be recruited to a CRISPR-Cas effector protein that comprises a guide RNA including one or more MS2 hairpins, and the cytosine deaminase and/or adenine deaminase comprise an affinity polypeptide (e.g., an scFv) and are recruited to the peptide tag.

According to some embodiments of the present invention, the invention provides a method of modifying a target nucleic acid, the method comprising contacting the target nucleic acid with: a CRISPR-Cas effector protein (e.g., a CRISPR enzyme), a guide nucleic acid (e.g., a guide RNA), and a cytosine deaminase, wherein the method modifies a cytosine (C) of the target nucleic acid to an adenine (A), guanine (G), or thymine (T). In some embodiments, C is converted to a T, G, or A in a semi-random fashion. In some embodiments, the target nucleic acid is present in a plant cell. The CRISPR-Cas effector protein, the guide nucleic acid, and the cytosine deaminase may form a complex or may be comprised in a complex. In some embodiments, the complex may be devoid of a glycosylase inhibitor (e.g. UGI) or domain thereof and/or the cytosine deaminase is devoid of a glycosylase inhibitor (e.g. UGI) or domain thereof. The CRISPR-Cas effector protein may be a Type V CRISPR-Cas effector protein. In some embodiments, the CRISPR-Cas effector protein is a Cas9 (e.g., dCas9 or nCas9). The method, composition, and/or system may provide a base substitution frequency of greater than about 0.1%, 0.5%, 1%, 1.25%, 1.5%, 1.75%, 2%, 2.25%, 2.5%, 2.75%, 3%, 3.25%, 3.5% 3.75%, 4%, 4.25%, 4.5%, 4.75%, 5%, 10%, 15%, 20%, 25%, 30%, 35%, 40%, 45%, 50%, 55%, 60%, 65%, 70%, 75%, or more, optionally wherein the base substitution frequency of C to non-T edits (e.g., C to G edits and/or C to A edits) of greater than 0.1%, 0 0.5%, 1%, 1.25%, 1.5%, 1.75%, 2%, 2.25%, 2.5%, 2.75%, 3%, 3.25%, 3.5%, 3.75%, 4%, 4.25%, 4.5%, 4.75%, 5%, 10%, 15%, 20%, 25%, 30%, or more. In some embodiments, the method, composition, and/or system may provide a base substitution frequency of greater than about 1%, optionally wherein the base substitution frequency of C to non-T edits (e.g., C to G edits and/or C to A edits) is greater than about 1%. It was surprisingly discovered by the inventors of the present application that methods, compositions, and/or systems of the present invention could provide an improved base substitution frequency and an improved ratio of C to G changes compared to C to T changes. For example, in some embodiments, a method, composition, and/or system of the present invention may provide a ratio of about 1:1 for C→G:C→T changes, optionally in plants. In some embodiments, a method, composition, and/or system of the present invention may provide a ratio of C→G:C→T changes of about 0.1:1, 0.2:1, 0.3:1, 0.4:1, 0.5:1, 0.6:1, 0.7:1, 0.8:1, 0.9:1, 1:1, 1.1:1, 1.2:1, 1.3:1, 1.4:1, 1.5:1, optionally in plants.

The cytosine deaminase may comprise a MCP or a portion thereof, optionally wherein the MCP or portion thereof is fused to the N-terminus of the cytosine deaminase amino acid sequence. In some embodiments, the cytosine deaminase comprises a Cas9 domain, optionally wherein the cytosine deaminase is fused to the Cas9 domain. In some embodiments, the cytosine deaminase comprises a deactivated LbCpf1 (dLbCpf1), optionally wherein the cytosine deaminase is fused to dLbCpf1. The cytosine deaminase may be codon-optimized. In some embodiments, the cytosine deaminase is codon-optimized for monocot expression and/or is codon-optimized for dicot expression.

In some embodiments, a method, composition, and/or system of the present invention may provide and/or generate an abasic site. The abasic site may be used as a template for translesion DNA synthesis. During polymerization, any nucleotide may be incorporated opposite the abasic site, as the sugar ring lacks the DNA base that can participate in base-pairing during polymerization. Thus, in some embodiments, the target C may be converted into a T, G, or A in a semi-random fashion. In some embodiments, the target nucleic acid may be contacted with a uracil N-glycosylase (UNG). UNG may be present in the cell in which the target nucleic acid is present. In some embodiments, a glycosylase domain (e.g., a UNG domain) may be recruited to the target nucleic acid via a covalent and/or non-covalent interaction, optionally via an antibody-epitope interaction and/or a RNA-binding motif-MS2 interaction.

In some embodiments, a method, composition, and/or system of the present invention comprises an adenine-modifying enzyme (e.g., an adenine deaminase), a CRISPR-Cas effector protein, and a glycosylase. The CRISPR-Cas effector protein may bind to a target nucleic acid and the adenine-modifying enzyme (e.g., adenine deaminase) can deaminate an adenine into inosine base. Inosine may then be glycosylated by the glycosylase (e.g., inosine glycosylase), which may be fused to the CRISR-Cas effector portion and/or adenine-modifying enzyme and/or recruited to the target site, CRISR-Cas effector portion, and/or adenine-modifying enzyme. Glycosylation can produce an abasic site, and DNA repair by translesion DNA polymerase can result in the incorporation of various DNA bases resulting in adenine mutagenesis into a C or T or G base. In some embodiments, the adenine-modifying enzyme is an engineered adenine deaminase, which can generate an inosine. In some embodiments, the adenine deaminase comprises an amino acid sequence having at least 70%, 75%, 80%, 85%, 90%, 95%, 96%, 97%, 98%, 99%, or more sequence identity to SEQ ID NO:56 or SEQ ID NO:57. In some embodiments, the CRISPR-Cas effector protein comprises an amino acid sequence having at least 70%, 75%, 80%, 85%, 90%, 95%, 96%, 97%, 98%, 99%, or more sequence identity to SEQ ID NO:39.

According to some embodiments, provided are base diversifying compositions and/or systems and/or base diversifiers (e.g., adenine base diversifying compositions and/or systems and/or adenine base diversifiers) that comprise a CRISPR-Cas effector protein, an adenine-modifying enzyme (e.g., an adenine deaminase), and a glycosylase (e.g., an inosine glycosylase). In some embodiments, a glycosylase may be fused to the N-terminus or to the C-terminus of a CRISPR-Cas effector protein, optionally with a linker in between, and/or may be fused to the N-terminus or to the C-terminus of an adenine-modifying enzyme (e.g., an adenine deaminase), optionally with a linker in between. In some embodiments, a CRISPR-Cas effector protein and an adenine-modifying enzyme are fused together to provide a fusion protein and a glycosylase may be fused to the N-terminus or to the C-terminus of the fusion protein, optionally with a linker in between. A linker used in a fusion protein of the present invention may comprise an amino acid sequence having at least 70%, 75%, 80%, 85%, 90%, 95%, 96%, 97%, 98%, 99%, or more sequence identity to SEQ ID NO:121 or SEQ ID NO:122. In some embodiments, a glycosylase provided at the C-terminus of a CRISPR-Cas effector protein and/or an adenine-modifying enzyme may include a linker in between comprising an amino acid sequence having at least 70%, 75%, 80%, 85%, 90%, 95%, 96%, 97%, 98%, 99%, or more sequence identity to SEQ ID NO:121. In some embodiments, a glycosylase provided at the N-terminus of a CRISPR-Cas effector protein and/or an adenine-modifying enzyme may include a linker in between comprising an amino acid sequence having at least 70%, 75%, 80%, 85%, 90%, 95%, 96%, 97%, 98%, 99%, or more sequence identity to SEQ ID NO:122. In some embodiments, a fusion protein of the present invention may comprise, from the N- to C-terminus, a glycosylase fused optionally with a linker to a deaminase that is fused optionally with a linker to a CRISPR-Cas effector protein. In some embodiments, a fusion protein of the present invention may comprise, from the N- to C-terminus, a deaminase fused optionally with a linker to a CRISPR-Cas effector protein that is fused optionally with a linker to a glycosylase.

In some embodiments, a CRISPR-Cas effector protein, an adenine-modifying enzyme (e.g., an adenine deaminase), a glycosylase (e.g., an inosine glycosylase) and/or a fusion protein comprising two or more thereof may comprise a nuclear localization signal at the N-terminus and/or C-terminus. In some embodiments, the nuclear localization signal (NLS) comprises an amino acid sequence having at least 70%, 75%, 80%, 85%, 90%, 95%, 96%, 97%, 98%, 99%, or more sequence identity to SEQ ID NO:129 or SEQ ID NO:130, optionally wherein a C-terminal NLS comprises an amino acid sequence having at least 70%, 75%, 80%, 85%, 90%, 95%, 96%, 97%, 98%, 99%, or more sequence identity to SEQ ID NO:129 and a N-terminal NLS comprises an amino acid sequence having at least 70%, 75%, 80%, 85%, 90%, 95%, 96%, 97%, 98%, 99%, or more sequence identity to SEQ ID NO:130. In some embodiments, the cytosine deaminase may be one or more of rAPOBEC1, APOBEC3A, APOBEC3B, hAID, and pmCDA1, and the cytosine deaminase may optionally be fused to an affinity polypeptide such as a MCP or portion thereof. As one of skill in the art will understand, different cytosine deaminases can generate different levels of base editing as well as product base profiles in different nucleotide compositions; thus, a cytosine deaminase may be chosen for a desired editing window at the target nucleic acid site. The cytosine deaminase may be recruited to the target nucleic acid via a covalent and/or non-covalent interaction, optionally via an antibody-epitope interaction and/or a RNA-binding motif-MS2 interaction. In some embodiments, the cytosine deaminase may comprise (e.g., be fused to) an MCP or portion thereof. The MCP or portion thereof may be fused to the N-terminus of the cytosine deaminase or the C-terminus of the deaminase. In some embodiments, the guide nucleic acid may comprise one or more RNA recruiting motifs (e.g., one or more MS2 hairpins). In some embodiments, the CRISPR-Cas effector protein may be fused to the cytosine deaminase. In some embodiments, the CRISPR-Cas effector protein may comprise a peptide tag and the cytosine deaminase may comprise an affinity polypeptide capable of binding to the peptide tag or the cytosine deaminase may comprise a peptide tag and the CRISPR-Cas effector protein may comprise an affinity polypeptide capable of binding to the peptide tag.

A method of the present invention may comprise modulating DNA-binding affinity of the CRISPR-Cas effector protein. During cytosine base editing, cytidine is converted into uridine via cytidine deamination. Thus, uridine/uracil is an intermediate product. In some embodiments, a method, composition, and/or system of the present invention may increase the lifetime of the uridine/uracil intermediate compared to a method, composition and/or system that is not in accordance with the present invention (e.g., compared to, in some embodiments, a method, composition, and/or system comprising a complex that comprises a UGI and/or a cytosine deaminase comprising a UGI). In some embodiments, the guide nucleic acid of the present invention has less than complete complementarity to the target nucleic acid such as less than 100% complementarity (e.g., less than 99%, 98%, 97%, 96%, 95%, 94%, 93%, 92%, 91%, 90%, etc.), which may increase the lifetime of the uridine/uracil intermediate compared to the lifetime of the uridine/uracil intermediate in a method with a guide nucleic acid having 100% complementarity. In some embodiments, the CRISPR-Cas effector protein of the present invention (e.g., Cas9) has an attenuated interaction with the target nucleic acid, which may generate an abasic site and/or increase the lifetime of the uridine/uracil intermediate compared to the lifetime of the uridine/uracil intermediate with a CRISPR-Cas effector protein that does not have an attenuated interaction with the target nucleic acid. In some embodiments, the method may comprise blocking the uridine/uracil intermediate from a uracil N-glycosylase until during and/or after DNA replication. For example, in some embodiments, the CRISPR-Cas effector protein and/or the cytosine deaminase may be retained at the target site, which may shield the uridine/uracil intermediate it has generated from UNG until the complex is dissolved during DNA replication, as it may lead to a favorable scenario where an abasic site generated during DNA replication may be preferentially used as a template for DNA polymerase. In some embodiments, the method of the present invention may comprise modulating (e.g., increasing or decreasing) residence time of the CRISPR-Cas effector protein at the target nucleic acid.

In some embodiments, the method comprises performing the contacting step in the presence of an AP endonuclease I (APE1) inhibitor and/or further comprises contacting the target nucleic acid with an APE1 inhibitor. One or more APE1 inhibitor(s) may be present in a method, composition, and/or system of the present invention. In some embodiments, the APE1 inhibitor is an organic compound or nucleic acid (e.g., siRNA). Exemplary APE1 inhibitors include, but are not limited to, those described in Curr Mol Pharmacol. 2012 January; 5(1):14-35; Mol Pharmacol., 2008, 73, 669-677; Madhusudan et al. Nucleic Acids Research, 2005, Vol. 33, No. 15 4711-4724; and J. Med. Chem., 2009, 52, 20-32, each of which are incorporated herein by reference in their entirety. In some embodiments, the APE1 inhibitor comprises CRT0044876. A method of the present invention may comprise inhibiting APE1, optionally inhibiting APE1 during at least a portion of the contacting step and/or base editing. In some embodiments, a siRNA may be used to inhibit cellular APE1.

In some embodiments, a method of the present invention comprises inhibiting or reducing indel formation, optionally compared to the amount of indel formation in the absence of an APE1 inhibitor and/or siRNA. In some embodiments, a method of the present invention may provide modified target nucleic acids with less than about 50%, 45%, 40%, 35%, 30%, 25%, 20%, 15%, 10%, 5%, 4%, 3%, 2%, 1%, or 0.5% of the modified target nucleic acids comprising indels. In some embodiments, a method of the present invention may improve the base diversification rate by decreasing the amount of indels generated.

A method of the present invention may comprise modulating one or more cellular pathway(s). In some embodiments a method of the present invention may reduce non-homologous end joining (NHEJ), optionally by inhibitition of DNA ligase IV and/or by DNA-PKcs. In some embodiments, the method comprises performing the contacting step in the presence of a DNA ligase IV inhibitor and/or a DNA-PKcs inhibitor and/or the method further comprises contacting the target nucleic acid with a DNA ligase IV inhibitor and/or a DNA-PKcs inhibitor. In some embodiments, a DNA ligase IV inhibitor and/or a DNA-PKcs inhibitor may be present during a base editing and/or base diversification event in the method of the present invention. Exemplary DNA ligase IV inhibitors include, but are not limited to, Scr7, L189, and those described in Cancer Res. 2008 May 1; 68(9):3169-77, which is incorporated herein by reference in its entirety. In some embodiments, the DNA ligase IV inhibitor may be Scr7. Use of Scr7 has been shown to increase HDR and reduce NHEJ during CRISPR/Cas9 mediated genome editing (Nat Biotechnol. 2015 May; 33(5): 538-542; FEBS J. 2015 November; 282(22):4289-94). Exemplary DNA-PKcs inhibitors include, but are not limited to, NU7026, KU-0060648, NU7441, IC86621, and those described in Sci Rep. 2019 Feb. 12; 9(1):1847; Genome Med. 2015 Aug. 27; 7:93; and Mol Cell Biol. 2011 April; 31(8):1719-33, which are each incorporated herein by reference in their entirety. In some embodiments, a method of the present invention may suppress NHEJ, optionally during base editing or base diversification, and may increase or improve base editing and/or base diversification and/or may decrease indel formation.

In some embodiments, the method may comprise inhibiting one or more protein(s) in a NHEJ pathway, which may lead to a reduction in the amount of indels generated during the method. In some embodiments, the method may comprise modulating a CRISPR-mediated indel rate and/or homology-directed repair (HDR) rate. Exemplary compounds that may inhibit one or more protein(s) in a NHEJ pathway and/or modulate a CRISPR-mediated indel and/or homology-directed repair (HDR) rate include, but are not limited to, those described in FEBS J. 2015 November; 282(22):4289-94, which is incorporated herein by reference in its entirety.

In some embodiments, a method of the present invention may promote or increase polymerization-mediated repair of an abasic site. In some embodiments, the method comprises performing the contacting step in the presence of an exogenous polymerase and/or further comprises contacting the target nucleic acid with an exogenous polymerase. An exogenous polymerase may increase and/or force polymerization over an abasic site by bringing a DNA polymerase to the target nucleic acid. An exogenous polymerase may be recruited to the target nucleic acid by a complex comprising the CRISPR-Cas effector protein, the guide nucleic acid, and the cytosine deaminase, or may be recruited to the target nucleic acid by a different complex. In some embodiments, an exogenous polymerase may be fused to the CRISPR-Cas effector protein (e.g., a Type V CRISPR-Cas effector protein), optionally wherein the exogenous polymerase is fused to a Cas9 (e.g., dCas9 or nCas9). The exogenous polymerase may be codon-optimized, optionally codon-optimized for expression in plants. In some embodiments, overexpression of a polymerase and/or recruitment of a polymerase that is capable of activity across abasic sites (including those involved in translesion bypass, such as Rev1) may upregulate a pathway that leads to base diversification. Exemplary polymerases that may be used in a method, composition, and/or system of the present invention include, but are not limited to, human Rev1, yeast Rev1, human polymerase iota, human polymerase kappa, engineered polymerase 3A10 (Nat Biotechnol. 2007 August; 25(8):939-43), human primase/polymerase PRIMPOL (Mol Cell. 2013 Nov. 21; 52(4):541-53), a phage polymerase B35DNAP (Proc Natl Acad Sci USA. 2015 Jul. 7; 112(27):E3476-84), a transposon-derived polymerase EhDNAPolB2 (PLoS One. 2012; 7(11):e49964), bacterial T4 DNA polymerase, and/or *Sulfolobus solfataricus* P2 DNA polymerase IV (Dpo4).

In some embodiments, the CRISPR-Cas effector protein comprises a peptide tag as described herein. In some embodiments, the peptide tag comprises a SunTag and/or the peptide tag comprises one or more (e.g., 1, 2, 3, 4, or more) GCN4 epitope(s). The cytosine deaminase may comprise an affinity polypeptide (e.g., an scFv) capable of binding the peptide tag, optionally wherein the cytosine deaminase and the affinity polypeptide are fused together. Accordingly, the cytosine deaminase may be recruited to the CRISPR-Cas effector protein and/or the target nucleic acid using the affinity polypeptide via binding to the peptide tag fused to the CRISPR-Cas effector protein.

In some embodiments, the cytosine deaminase comprises a peptide tag as described herein. In some embodiments, the peptide tag comprises a SunTag and/or the peptide tag comprises one or more (e.g., 1, 2, 3, 4, or more) GCN4 epitope(s). The CRISPR-Cas effector protein may comprise an affinity polypeptide (e.g., a scFv) capable of binding the peptide tag, optionally wherein the CRISPR-Cas effector protein and the affinity polypeptide are fused together. In some embodiments, the CRISPR-Cas effector protein is recruited to the target nucleic acid using the affinity polypeptide.

A method of the present invention may comprise contacting a target nucleic acid with a CRISPR Cas effector protein, a deaminase, and/or a fusion protein thereof and/or a polypeptide of interest, and/or the target nucleic acid may be contacted with a polynucleotide encoding a CRISPR Cas effector protein, a deaminase, and/or a fusion protein thereof and/or a polypeptide of interest, which polypeptide may optionally be comprised in one or more expression cassettes and/or vectors as described herein, said expression cassettes and/or vectors optionally comprising one or more guide nucleic acids.

As described herein, the nucleic acids of the invention and/or expression cassettes and/or vectors comprising the same may be codon optimized for expression in an organism. An organism useful with this invention may be any organism or cell thereof for which nucleic acid modification may be useful. An organism can include, but is not limited to, any animal (e.g., mammal), any plant, any fungus, any archaeon, or any bacterium. In some embodiments, the organism may be a plant or cell thereof.

In some embodiments, the nucleic acid constructs, expression cassettes or vectors of the invention that are optimized for expression in a plant may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the nucleic acid constructs, expression cassettes or vectors comprising the same polynucleotide(s) but which have not been codon optimized for expression in a plant.

A target nucleic acid of any plant or plant part may be modified using the nucleic acid constructs of the invention. Any plant (or groupings of plants, for example, into a genus or higher order classification) may be modified using the nucleic acid constructs of this invention including an angiosperm, a gymnosperm, a monocot, a dicot, a C3, C4, CAM plant, a bryophyte, a fern and/or fern ally, a microalgae, and/or a macroalgae. A plant and/or plant part useful with this invention may be a plant and/or plant part of any plant species/variety/cultivar. The term "plant part," as used herein, includes but is not limited to, embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast. A plant cell can be in the form of an isolated single cell or can be a cultured cell or can be a part of a higher-organized unit such as, for example, a plant tissue or a plant organ.

Non-limiting examples of plants useful with the present invention include turf grasses (e.g., bluegrass, bentgrass, ryegrass, fescue), feather reed grass, tufted hair grass, miscanthus, arundo, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, Chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, papaya, and lychee, a field crop plant such as clover, alfalfa, timothy, evening primrose, meadow foam, corn/maize (field, sweet, popcorn), hops, jojoba, buckwheat, safflower, quinoa, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), *Cannabis* (e.g., *Cannabis sativa, Cannabis indica*, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, eucalyptus, willow), as well as shrubs and other nursery stock. In some embodiments, the nucleic acid constructs of the invention and/or expression cassettes and/or vectors encoding the same may be used to modify maize, soybean, wheat, canola, rice, tomato, pepper, sunflower, raspberry, blackberry, black raspberry and/or cherry.

In some embodiments, the invention provides cells (e.g., plant cells, animal cells, bacterial cells, archaeon cells, and the like) comprising the polypeptides, polynucleotides, nucleic acid constructs, expression cassettes or vectors of the invention.

The present invention further comprises a kit or kits to carry out the methods of this invention. A kit of this invention can comprise reagents, buffers, and apparatus for mixing, measuring, sorting, labeling, etc, as well as instructions and the like as would be appropriate for modifying a target nucleic acid.

In some embodiments, the invention provides a kit for comprising one or more nucleic acid constructs of the invention, and/or expression cassettes and/or vectors and/or cells comprising the same as described herein, with optional instructions for the use thereof. In some embodiments, a kit may further comprise a CRISPR-Cas guide nucleic acid (corresponding to the CRISPR-Cas effector protein encoded by the polynucleotide of the invention) and/or expression cassettes and/or vectors and or cells comprising the same. In some embodiments, a guide nucleic acid may be provided on the same expression cassette and/or vector as one or more nucleic acid constructs of the invention. In some embodiments, the guide nucleic acid may be provided on a separate expression cassette or vector from that comprising the one or more nucleic acid constructs of the invention.

Accordingly, in some embodiments, kits are provided comprising a nucleic acid construct comprising (a) a polynucleotide(s) as provided herein and (b) a promoter that drives expression of the polynucleotide(s) of (a). In some embodiments, the kit may further comprise a nucleic acid construct encoding a guide nucleic acid, wherein the construct comprises a cloning site for cloning of a nucleic acid sequence identical or complementary to a target nucleic acid sequence into backbone of the guide nucleic acid.

In some embodiments, the nucleic acid construct of the invention may be an mRNA that may encode one or more introns within the encoded polynucleotide(s). In some embodiments, the nucleic acid constructs of the invention, and/or an expression cassettes and/or vectors comprising the same, may further encode one or more selectable markers useful for identifying transformants (e.g., a nucleic acid encoding an antibiotic resistance gene, herbicide resistance gene, and the like).

A polypeptide, polynucleotide, nucleic acid construct, expression cassette, vector, composition, kit, system and/or cell of the present invention may comprise all or a portion of a sequence of one or more of SEQ ID NOs:1-283. In some embodiments, a polypeptide, polynucleotide, nucleic acid construct, expression cassette, vector, composition, kit, system and/or cell of the present invention may comprise at least about 20%, 25%, 30%, 35%, 40%, 45%, 50%, 55%, 60%, 65%, 70%, 75%, 80%, 85%, 90%, 95%, 96%, 97%, 98%, 99%, or more consecutive amino acids of a sequence of one or more of SEQ ID NOs:1-283.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1: MS2/MCP System for C and A Editing Using Recruitment

In this system, a CRISPR-Cas effector protein (e.g., enzyme), cytosine deaminase, adenine deaminase, and guide RNA are delivered. The CRISPR-Cas effector protein is fused to either a cytosine deaminase domain (CBE) or an adenine deaminase domain (ABE) and the other deaminase is recruited to the target nucleic acid using a MS2 hairpin. In HEK293T cells, plasmids encoding CBE or ABE, MCP-C-deaminase or MCP-A-deaminase (complementing CBE or ABE), and guide RNA containing MS2 hairpin were transfected. After 3 d, the cells were harvested and analyzed using high-throughput sequencing (FIG. 1).

As an example, HEK2 loci (SEQ ID NO:131) was targeted with BE4Max and MCP-2×TadA (Table 1). A large fraction of cell population had both C and A edited (Table 1). In addition, several alleles containing multiple numbers of mutations were obtained at high frequency (Table 1).

TABLE 1

Allele frequency chart of a sample targeted with a version of concurrent base editor.

| Edit type | Allele | % Read |
|---|---|---|
| Reference (WT) | GAACACAAAGCATAGACTGC (SEQ ID NO: 131) | 51.3 |
| Both edited | GAATGTAAAGCATAGACTGC (SEQ ID NO: 277) | 12.6 |
| C to T edited | GAATATAAAGCATAGACTGC (SEQ ID NO: 278) | 10.5 |
| C to G edited | GAACAGAAAGCATAGACTGC (SEQ ID NO: 279) | 5.7 |
| Both edited | GAACGTAAAGCATAGACTGC (SEQ ID NO: 280) | 3.8 |
| C to T edited | GAACATAAAGCATAGACTGC (SEQ ID NO: 281) | 2.2 |

Example 2: SunTag System for C and A Editing

Figure 2:
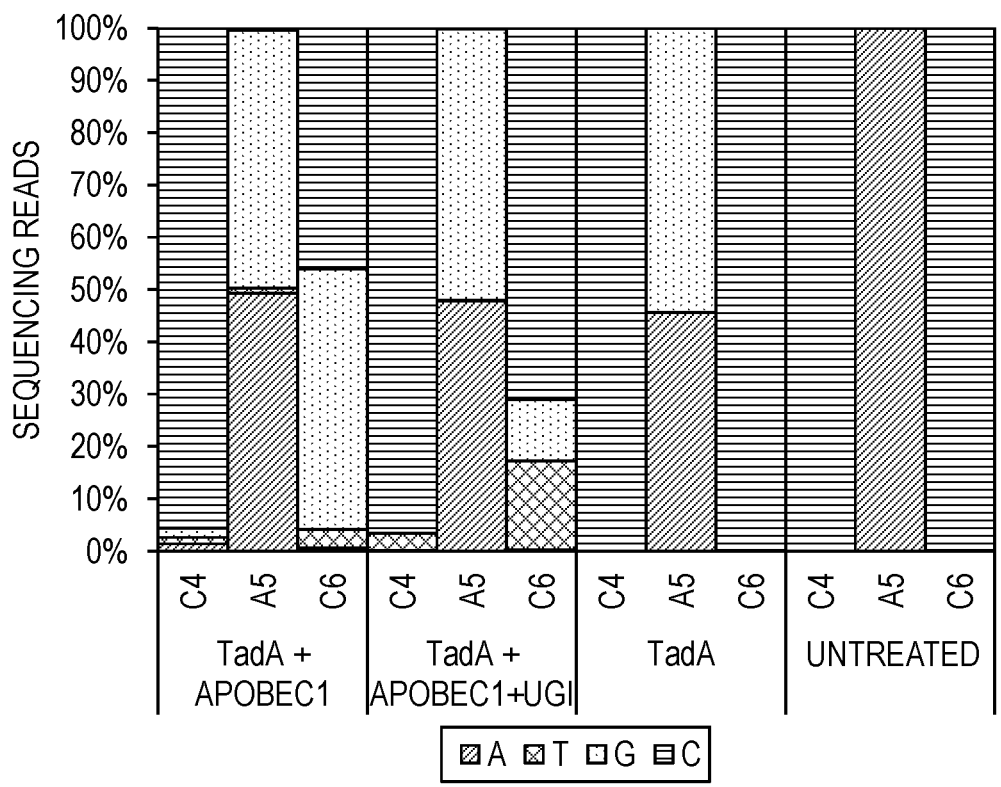
FIG. 2 is a graph showing C- and A-base editing results using a SunTag system with Cas9 according to some embodiments of the present invention.

The N- or C-terminus of a CRISPR-Cas effector protein (e.g., enzyme), nCas9(D10A), was fused to a SunTag, which contains multiples of GCN4 epitope. A single chain variable fragment antibody (scFv) that recognizes GCN4 was fused to adenine and cytidine deaminases either separately or as a single fusion, but in this example was separate fused to the adenine and cytidine deaminases. UGI can be provided as a fusion or in trans, but in this example was provided in trans. Upon binding, both deaminases will be recruited simultaneously towards the target site and perform C and A editing within the deamination window (e.g., a sub-sequence in target site where base editing is typically observed). Such a system was used for two different guide RNAs in HEK cells. At these loci, robust diversification of targeted C and A were observed as can be seen in FIG. 2 for the target nucleic acid of SEQ ID NO:131. Robust diversification of C and A in the window was observed (FIG. 2).

Example 3: TREE System for C and A Editing

Figure 3:
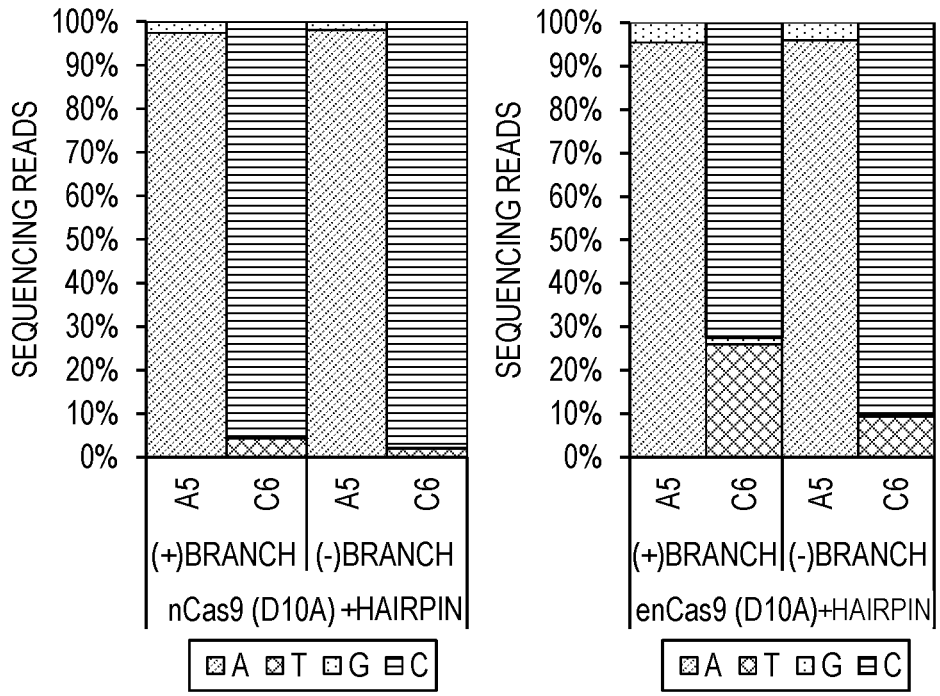
FIG. 3 provides graphs showing C- and A-base editing results using a TREE system according to some embodiments of the present invention.

In a TREE system, the CRISPR-Cas effector protein (e.g., enzyme) contains a guide RNA modified with MS2 hairpins. Then, a SunTag epitope is recruited to MS2 hairpin via fusion to MCP protein (termed "branch"). Finally, protein of interest is recruited to SunTag by being fused to the antibody that binds to SunTag. The TREE system was employed using nCas9 (D10A) or enCas9 (D10A), MCP-SunTag, scFv-APOBEC1 and scFv-2×TadA in HEK293T cells. It resulted in mutagenesis of both adenine and cytidine residues in the window (FIG. 3) for the target nucleic acid of SEQ ID NO:131. As shown in FIG. 3, diversification was observed.

Example 4: Deaminase Screen for Diversification

Five deaminases who have been shown to be functional as a Cas9 fusion were assayed for base diversification function: rAPOBEC1, APOBEC3A, APOBEC3B, hAID, pmCDA1. They were fused to MCP (MS2 capping protein) at the N-terminus, and recruited towards Cas9 nickase (D10A) by using gRNA fused to 2×MS2 hairpins. They were assayed against several genomic sites in HEK293T cells. Base conversion profiles were analyzed by high-throughput sequencing and the results are shown in FIG. 4 for the target nucleic acid of SEQ ID NO:132.

Figure 4:
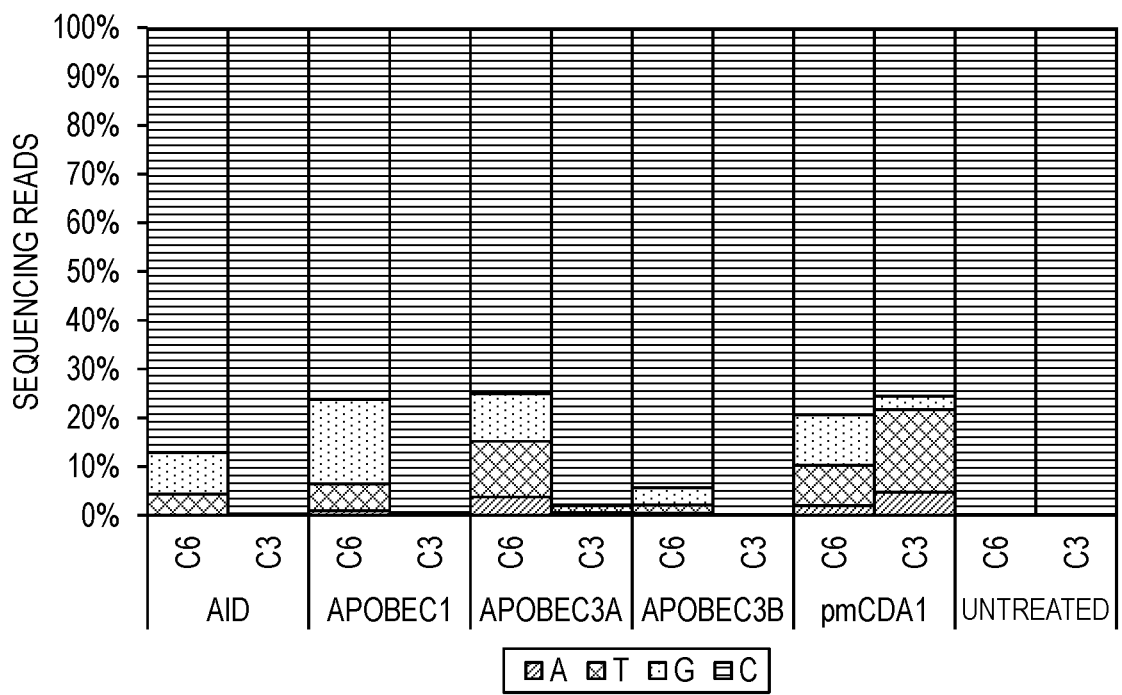
FIG. 4 is a graph showing base diversification mediated by Cas9 (D10A) using in-trans recruitment of various deaminase domains fused to a MCP according to some embodiments of the present invention.

APOBEC1, APOBEC3A, and pmCDA1 robustly converts C into G, T, and A nucleotides within the base editing window (FIG. 4). Each deaminase domain generates different levels of base editing as well as product base profiles in different nucleotide compositions (FIG. 4). Also, pmCDA1 prefers to edit cytidines farther away from the PAM site than APOBEC1 or APOBEC3A, hence different enzymes can be chosen for desired editing window at the target site (FIG. 4). This is the first demonstration of the use of APOBEC3B, pmCDA1 deaminases to induce non-C to T base changes.

Figure 5:
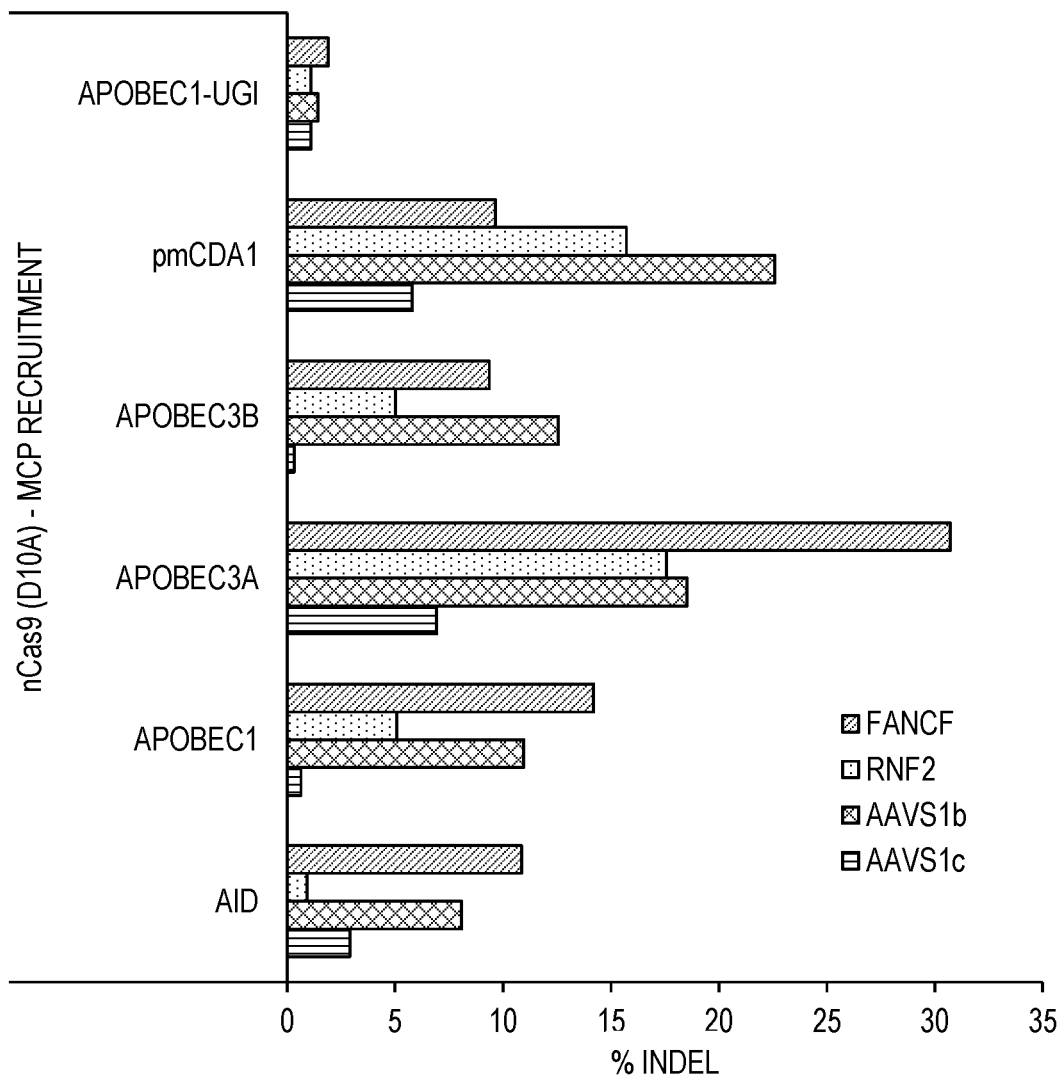
FIG. 5 is a graph showing that base diversification according to some embodiments of the present invention can generate a significant amount of indel mutations, regardless of deaminase domains, in the absence of UGI.
Figure 6A:
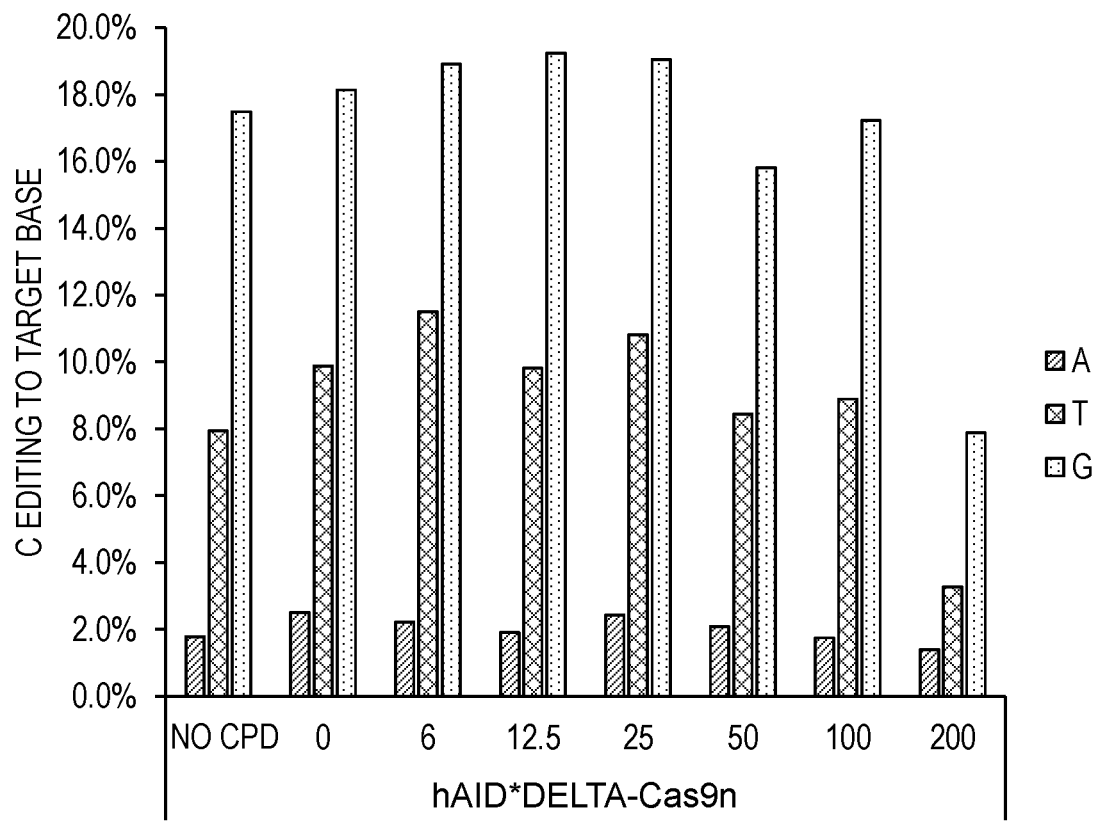
FIGS. 6A-6D are graphs showing C editing to a target base (FIG. 6A and FIG. 6C) and that CRT0044876 reduces the rate of indel mutations (FIG. 6B and FIG. 6D) according to some embodiments of the present invention.
Figure 6B:
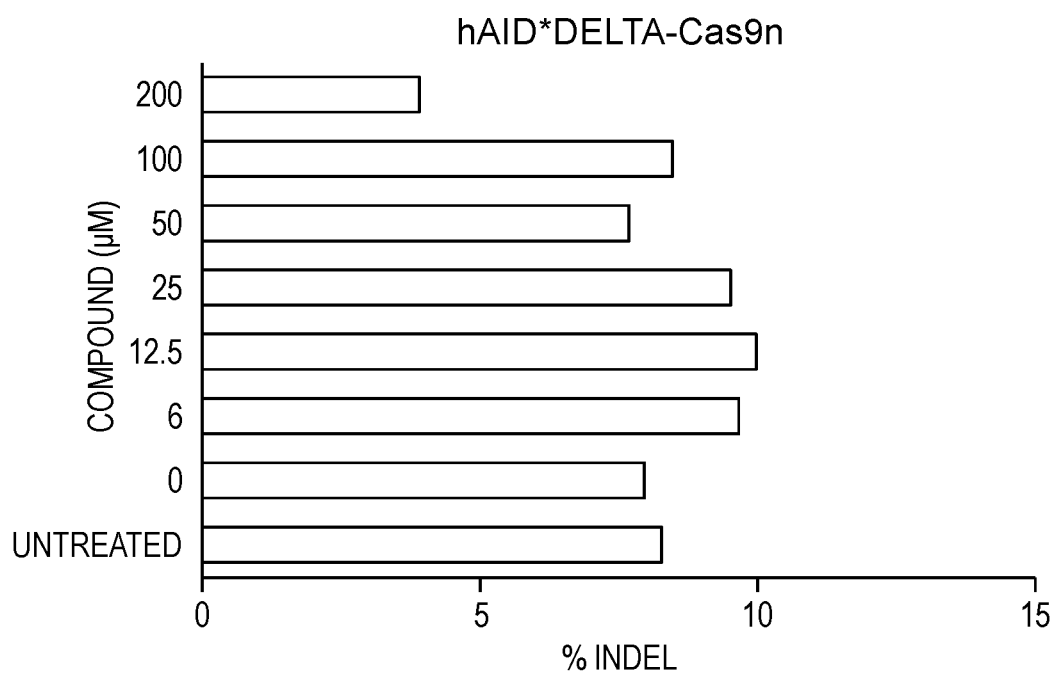
Figure 6C:
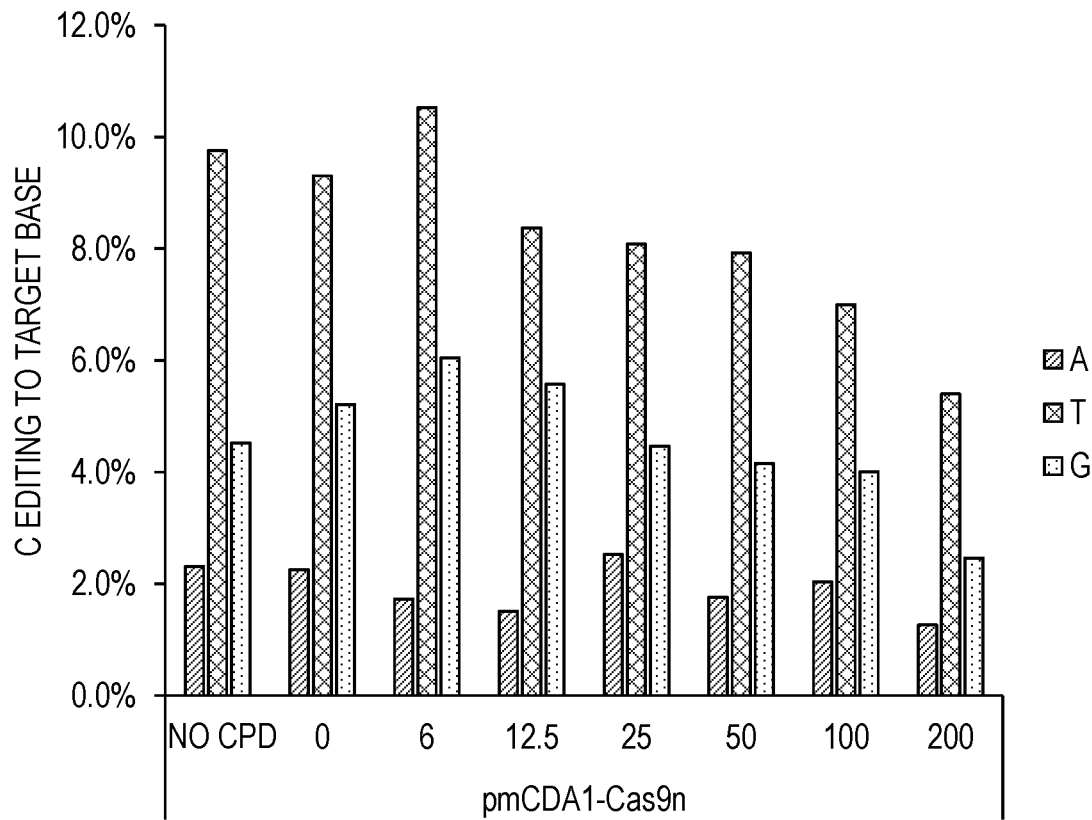
Figure 6D:
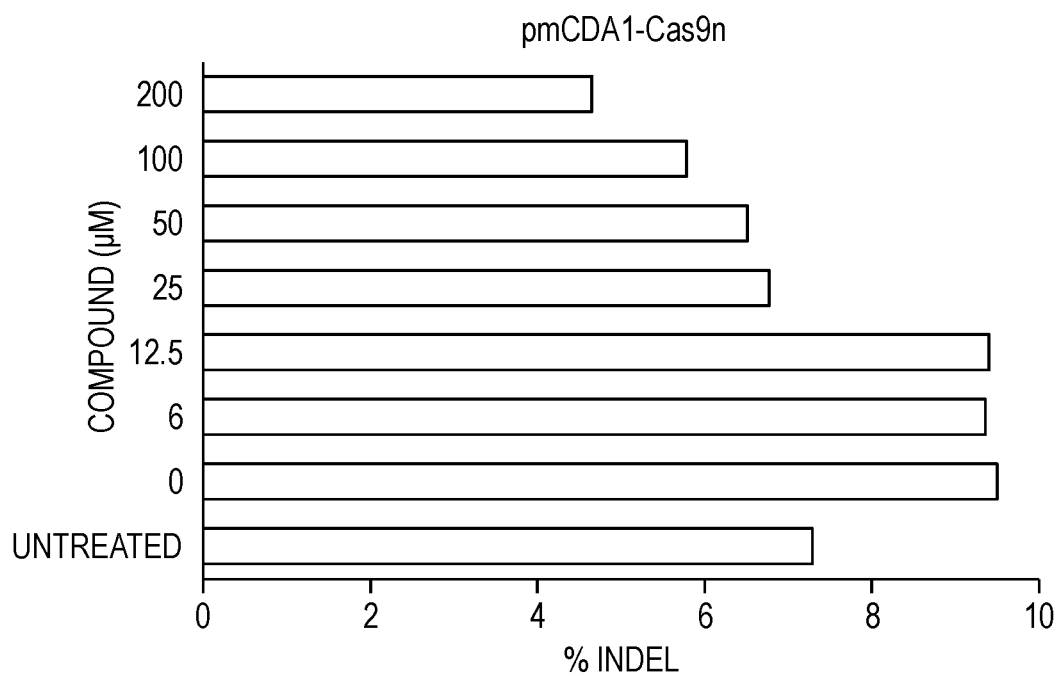

AP endonuclease I (APE1) is an enzyme within the base excision repair pathway that cleaves the phosphodiester bond at the abasic site, generating a nick in the base-edited strand. When combined with Cas9 nickase that nicks the non-base-edited strand, this results in a double-stranded break (DSB), causing indels. In constructs lacking UGI, base diversification is usually accompanied with indels. For example, in all target sites described above, about 5-20% of products contain indels, which lowers the efficiency of base diversification (FIG. 5).

Example 5: Modulation of Cellular Pathways—APE1 Inhibitor

APE1 was inhibited by using CRT0044876 (Scheme 1), which is a potent and well-known APE1 inhibitor.

Scheme 1 Chemical structure of CRT0044876.

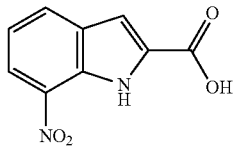

To ascertain whether this compound improves base diversification profile, HEK293T cells were treated with AID or pmCDA1 fused to Cas9 nickase (D10A) in the presence of CRT0044876. After 3 d, the cells were harvested and analyzed through high-throughput sequencing (HTS). At 100 µM and 200 µM concentrations, CRT0044876 led to a significant decrease in the amount of indel generated across multiple target sites, although some decrease in base diversification rate was also observed (FIGS. 6A-6D).

Example 6: Modulation of Cellular Pathways—siRNA

Cellular APE1 can be inhibited through siRNA. APE1 will be inhibited by using RNAi methods. We will transfect siRNA targeting endogenous APE1 either before or during the transfection of plasmids encoding base diversifier constructs. After incubation, the cells will be harvested and analyzed via HTS.

Example 7: DNA-PKcs Inhibitors and/or DNA Ligase IV Inhibitors

Compounds that inhibit DNA-PKcs (e.g., NU7026 and/or KU-0060648) and/or that inhibit DNA Ligase IV (e.g., Scr7) will be applied to HEK293T cells at varying doses. Plasmids encoding base diversifier constructs will be subsequently transfected to the cells. After 3 d incubation, the cells will be analyzed via HTS to assess base diversification rate at the target sites.

Example 8: Generation of Transversion Mutations from Adenine

The experiment was designed to generate transversion mutations from adenines by promoting inosines to undergo the same cellular DNA repair pathways that generate transversion mutations during translesion-bypass polymerization in cytosine base editing. While not wishing to be bound to any particular theory, it was hypothesized that the key step was to facilitate the glycosylation of inosines generated during adenine base editing. It was hypothesized that once glycosylated, the resulting abasic site can be a substrate for translesion-bypass repair and that this would lead to transversion mutations. Exogenous inosine glycosylases were provided along with ABE to promote inosine glycosylation.

Several inosine glycosylases were screened in HEK293T cells and it was determined whether they were capable of acting on inosines generated by ABE. If inosine is converted into an abasic site, and subsequently repaired through translesion-bypass polymerization, transversion mutations can be generated from adenines.

Figure 7A:
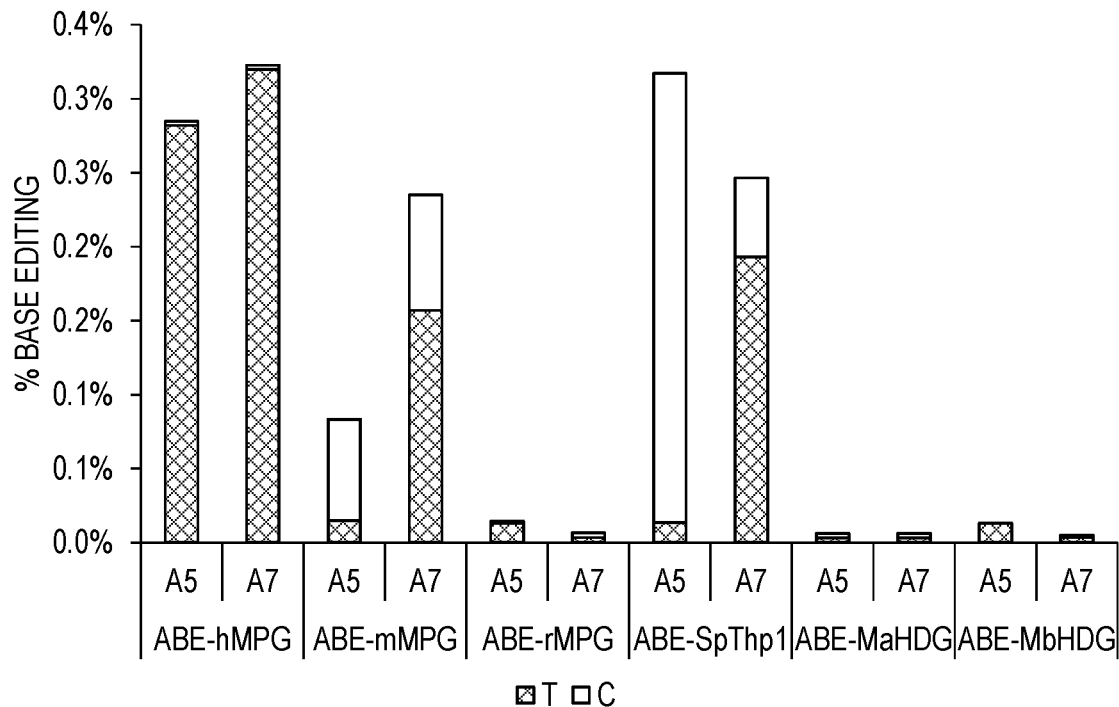
FIGS. 7A-7C are graphs showing adenine base editing results for a HEK2 genomic site. Adenines in the target window were diversified into cytosine and thymine. All conditions that used ABE generated ~10-20% guanine mutation, as expected.
Figure 7B:
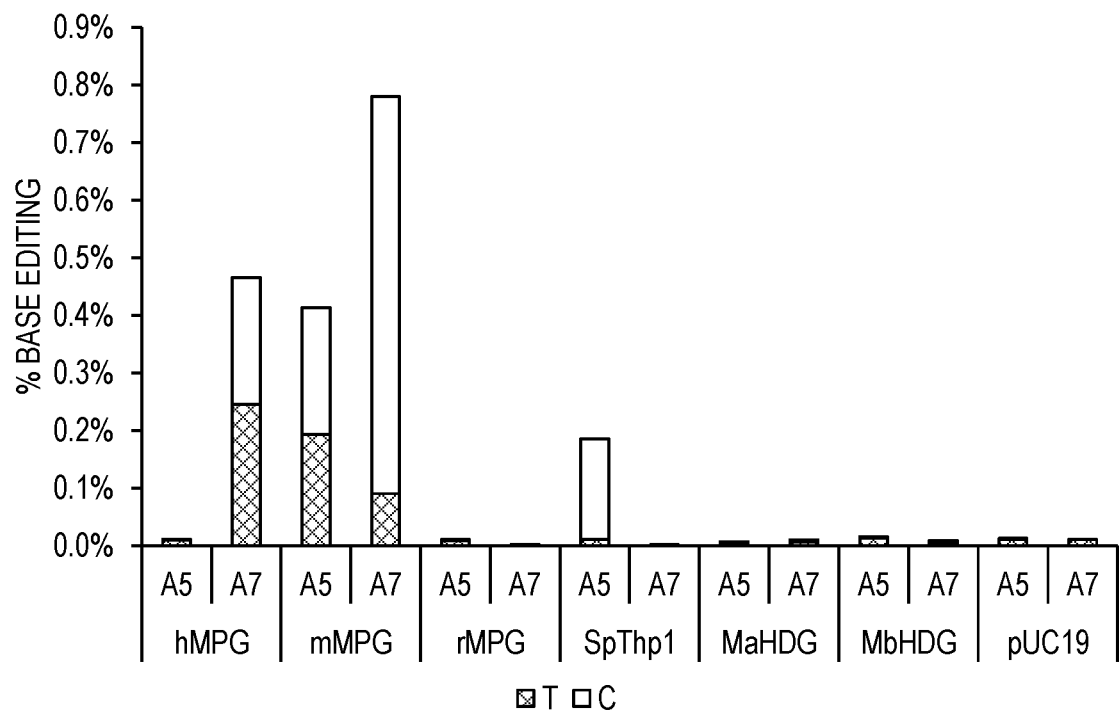
Figure 7C:
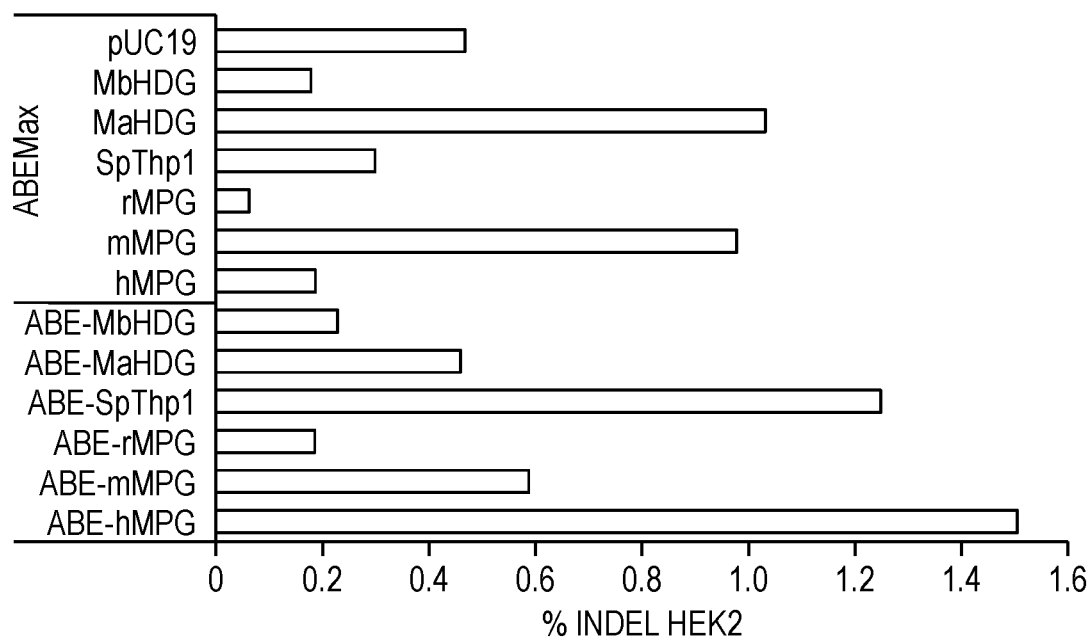
Figure 8A:
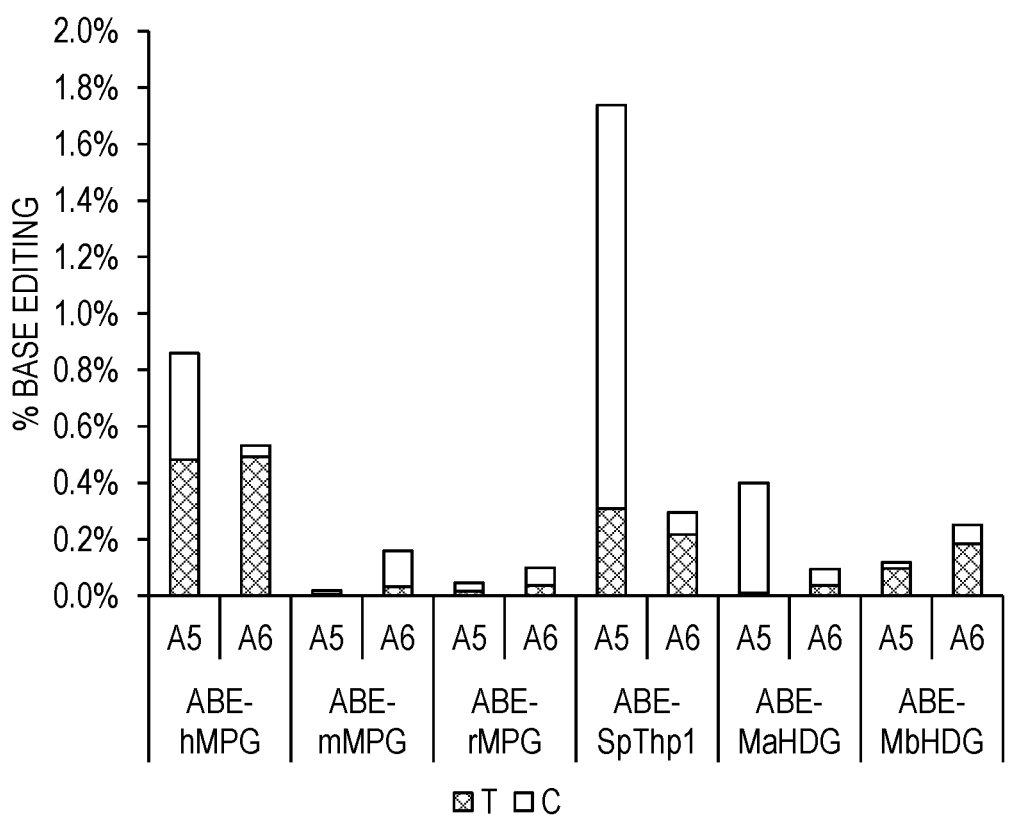
FIGS. 8A-8C are graphs showing adenine base editing results for a FANCF genomic site. Adenines in the target window were diversified into cytosine and thymine. All conditions that used ABE generated ~10-20% guanine mutation, as expected.
Figure 8B:
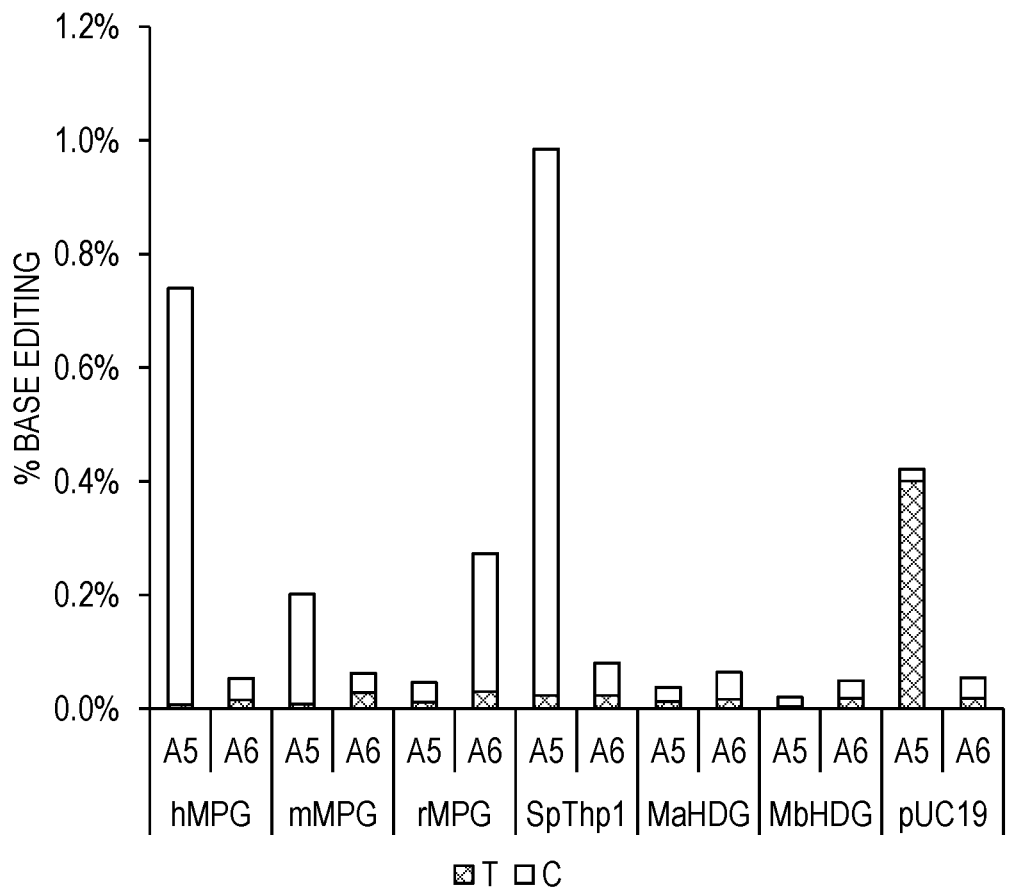
Figure 8C:
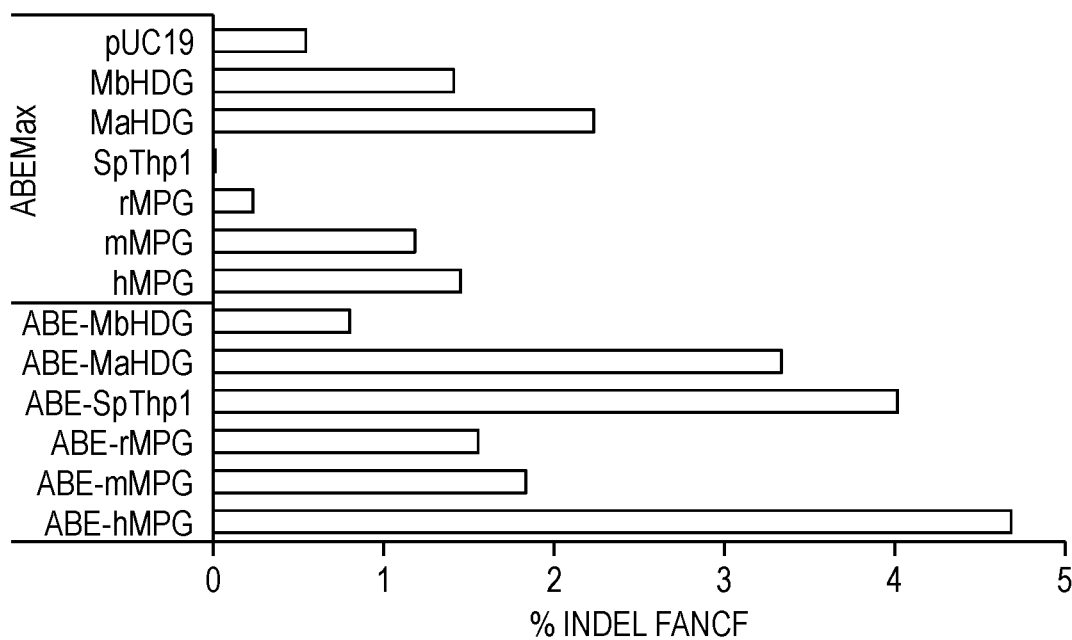

Five different glycosylases from various species were selected for testing. The following genes were codon-optimized and cloned into a mammalian expression vector, either as unfused gene, or as a C-terminal fusion to ABE7.10 (species source in parenthesis); hMPG (*Homo sapiens*) having an amino acid sequence of SEQ ID NO:84, mMPG (*Mus musculus*) having an amino acid sequence of SEQ ID NO:83, rMPG (*Rattus norvegicus*) having an amino acid sequence of SEQ ID NO:80, SpThp1 (*Schizosaccharomyces pombe*) having an amino acid sequence of SEQ ID NO:79, MaHDG (*Methanosarcina acetivorans*) having an amino acid sequence of SEQ ID NO:81, and MbHDG (*Methanosarcina barkeri*) having an amino acid sequence of SEQ ID NO:82. The unfused ABE7.10 had an amino acid sequence of SEQ ID NO:55, and the fusions tested included fusion proteins having an amino acid sequence of SEQ ID NO:123-128. The HEK293T cells were transfected with a plasmid encoding gRNA targeting endogenous loci and either the fusion plasmid or a mixture of plasmids expressing ABE7.10 and the above inosine glycosylases. After 3 days, high-throughput sequencing was used to determine the editing result of targeted adenines. Mock transfection (using pUC19) was used to set baseline editing. All conditions that used ABE7.10 generated 10-20% guanine transition, as expected. Interestingly, for both fusion constructs and co-transfected constructs, hMPG, mMPG, and SpThp1 were able to generate a significant amount of C and T bases over background as shown in FIGS. 7A-7B and FIGS. 8A-8B. Moreover, there is a slight increase in indel formation using some of these constructs (FIGS. 7C and 8C), suggesting that inosines generated by ABE7.10 are being glycosylated and sometimes causing double-stranded breaks from the activity of endogenous APE1 enzyme within the BER pathway.

Example 9: Fusion Architecture for Adenine Diversifiers

Several glycosylase domains were fused to either the N-terminus or C-terminus of ABE8.20m (SEQ ID NO:57). For the N-terminal fusions to ABE8.20m, the deaminase was between the glycosylase domain and CRISPR-Cas effector protein, and, for the C-terminal fusions to ABE8.20m, the CRISPR-Cas effector protein was between the glycosylase domain and deaminase. Three putative inosine glycosylases were tested, which are: hMPG, a methylpurine glycosylase (MPG) from *Homo sapiens* (SEQ ID NO:84, UniProtKB—P29372); mMPG from *Mus musculus* (SEQ ID NO:83, UniProtKB—Q04841); and SpThp1, a known uracil DNA glycosylase that also has activity towards inosine, from *Schizosaccharomyces pombe* (SEQ ID NO:79, UniProtKB—O59825) (Alseth et al. Nucleic Acids Research 2005, 33(3) 1123-1131). For C-terminal fusions, ABE8.20m was fused to an inosine glycosylase with a linker in between having a sequence of SEQ ID NO:121. For N-terminal fusions, ABE8.20m was fused to an inosine glycosylase with a linker in between having a sequence of SEQ ID NO:122.

The following plasmids were transfected into HEK293T cells: a plasmid encoding ABE8.20m or a fusion protein including ABE8.20m fused to one of the above inosine glycosylases, and a plasmid encoding a guide RNA. For each plasmid, the protein coding sequence was flanked by a N-terminal NLS having a sequence of SEQ ID NO:129 and C-terminal NLS having a sequence of SEQ ID NO:130. Four guide RNAs were tested corresponding to the following four target nucleic acids (i.e., sites): Site 1: GAACACAAAGCATAGACTGC (SEQ ID NO:131), Site 2: GTCATCTTAGTCATTACCTG (SEQ ID NO:132), Site 3: GCACAACCAGTGGAGGCAAG (SEQ ID NO:133), and Site 4: GCTCCAGAGCCGTGCGAATG (SEQ ID NO:134). After three days, the editing efficiency was measured by high throughput sequencing of targeted loci.

Figure 9:
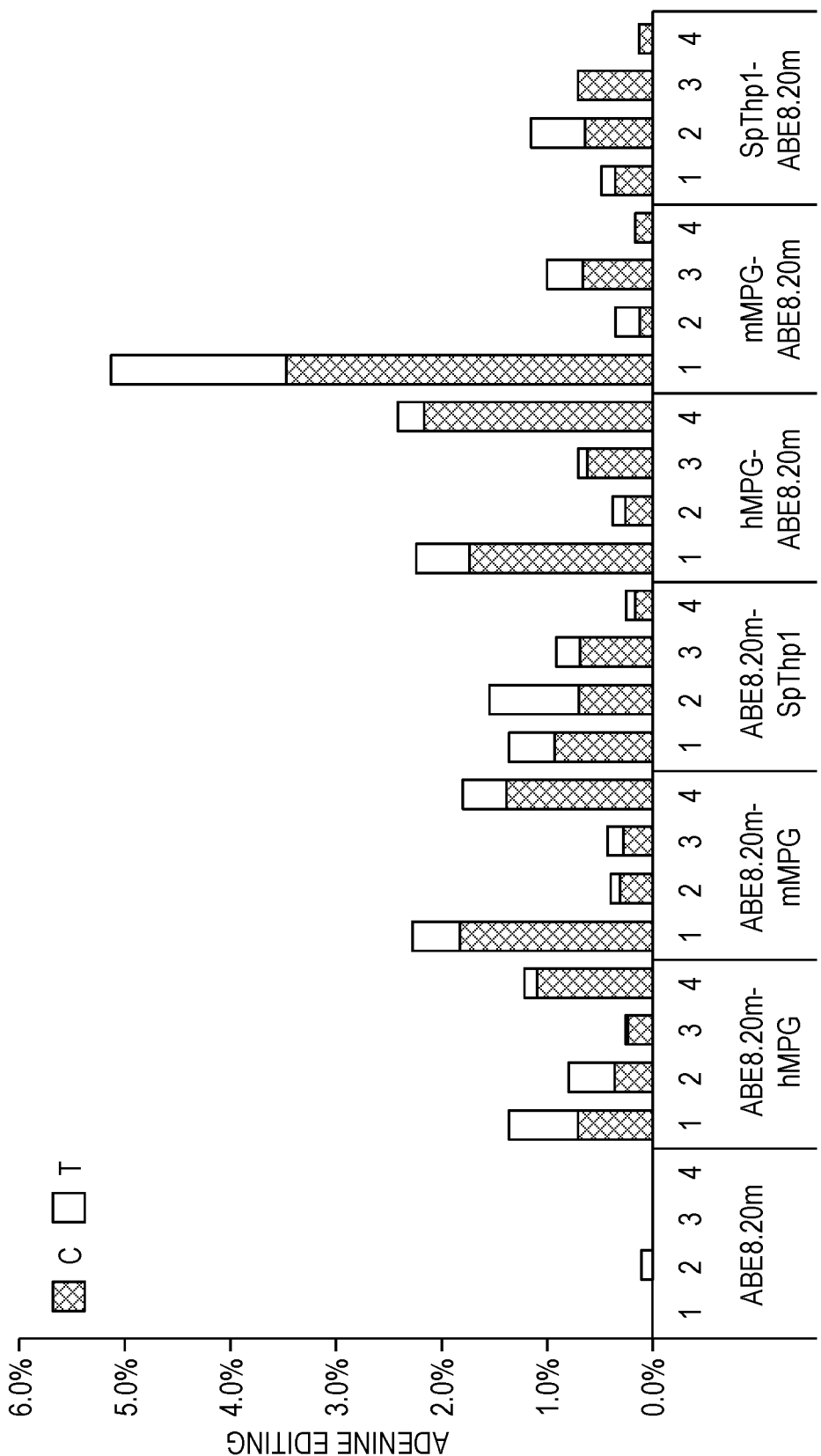
FIG. 9 is a graph showing the editing efficiency of target adenines in the base editing window to cytosine and thymine bases for each of the four sites (Sites 1-4) and for each of the different architectures for adenine base diversifiers.

FIG. 9 shows the editing efficiency of target adenines in the base editing window to cytosine and thymine bases for each of the four sites and different architectures. For all four guide RNAs tested, both fusion architectures resulted in the target adenine being converted to C or T (in addition to G), whereas ABE8.20m without the glycosylase domain showed negligible A to C or T change (FIG. 9).

Example 10: SunTag Recruitment System for Adenine Base Diversifier

Figure 10:
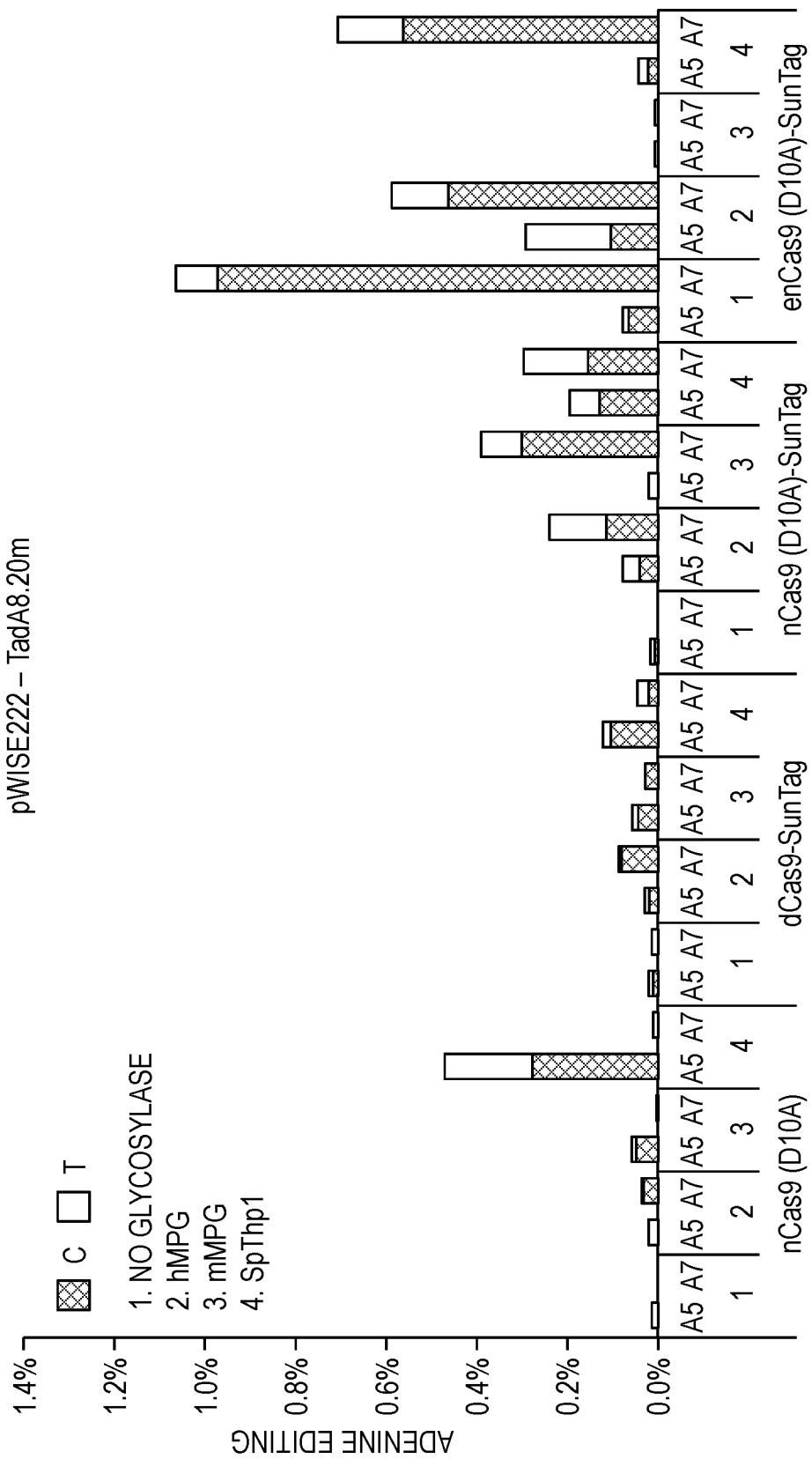
FIG. 10 is a graph showing the editing efficiency of target adenines in the base editing window to cytosine and thymine bases for TadA8.20m with (1) no glycosylase, (2) hMPG, (3) mMPg, or (4) SpThp1.
Figure 11:
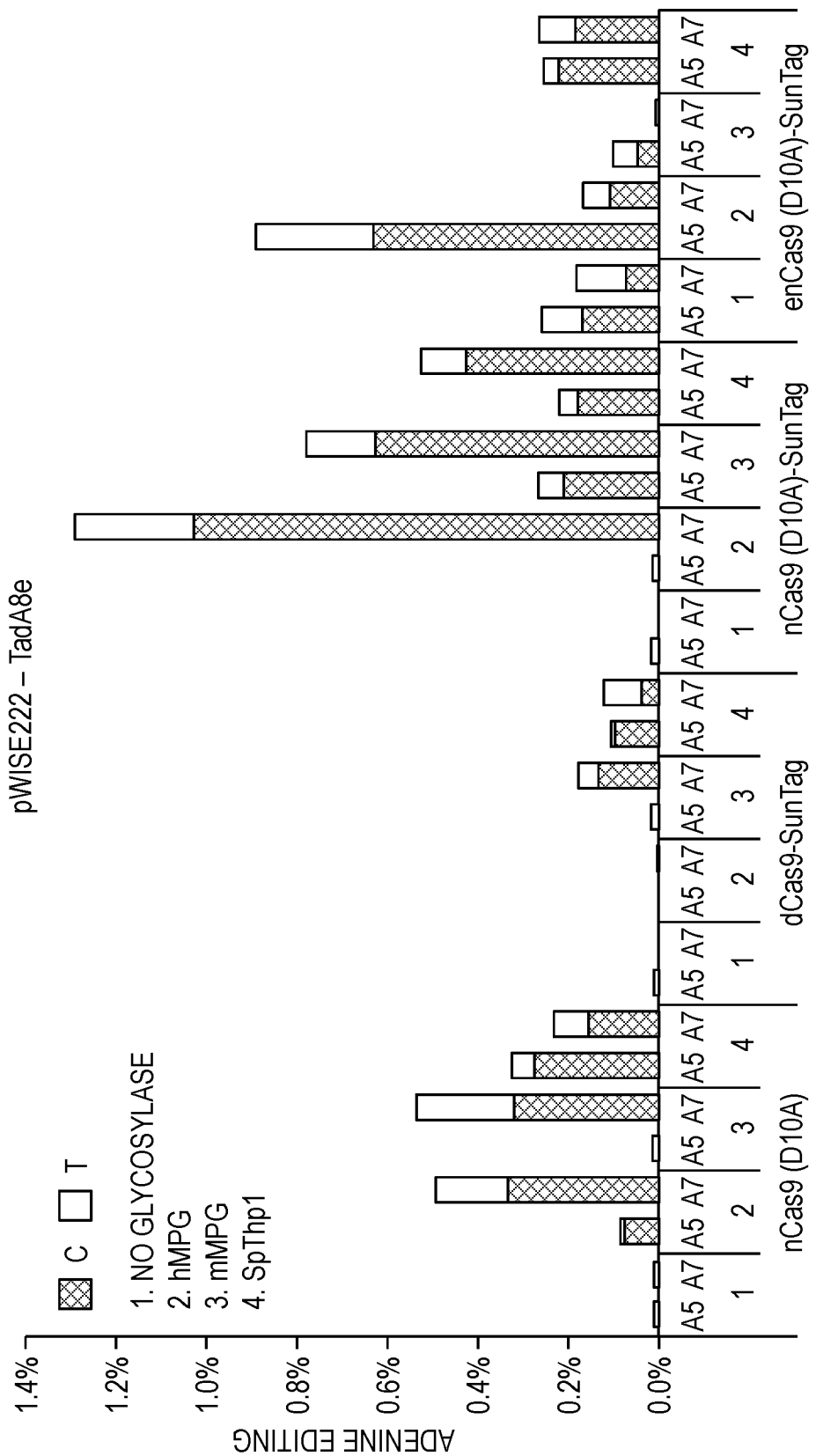
FIG. 11 is a graph showing the editing efficiency of target adenines in the base editing window to cytosine and thymine bases for TadA8e with (1) no glycosylase, (2) hMPG, (3) mMPg, or (4) SpThp1.

It was demonstrated that SunTag recruitment can be utilized to recruit inosine glycosylase to enable adenine diversification. Different forms of Cas9 were expressed in HEK293T cells, which were: nCas9(D10A) (SEQ ID NO:36), dCas9-SunTag (SEQ ID NO:135), nCas9(D10A)-SunTag (SEQ ID NO:136), and enCas9(D10A)-SunTag (SEQ ID NO:137), along with a SunTag-antibody-fused adenine deaminase, with a GB1 solubility tag at the C-terminus, having a sequence of SEQ ID NO:138 or SEQ ID NO:139. An inosine glycosylase, which was hMPG (SEQ ID NO:84), mMPG (SEQ ID NO:83), or SpThp1 (SEQ ID NO:79) was overexpressed in trans. The glycosylase was not actively recruited, but was expressed in the cell at the same time as the Cas9 and deaminase. It was observed that SunTag fusion to nCas9(D10A) leads to an increase in A to C or T editing compared to expression of nCas9(D10A) without SunTag (FIGS. 10 and 11).

Example 11: Reducing Cas9 Binding Affinity

In an attempt to reduce the Cas9 DNA binding affinity to a target nucleic acid, Cas9 having mutated amino acid residues that may interact with the target nucleic acid were used. Without being limited to any particular theory, the thought was that this would facilitate the dissociation of Cas9 from the target nucleic acid once adenine is converted to inosine; thus, providing greater access for inosine glycosylase. Specifically, enCas9(D10A) (SEQ ID NO:39) contains two mutations that reduce DNA binding affinity compared to nCas9(D10A) (Halperin et al. Nature 2018 560 (7717):248-252). The effect of the mutations in the context of SunTag-mediated adenine diversification were tested.

The following plasmids were transfected into HEK293T cells: a plasmid encoding one of the following Cas9 forms: nCas9(D10A) (SEQ ID NO:36), dCas9-SunTag (SEQ ID NO:135), nCas9(D10A)-SunTag (SEQ ID NO:136), and enCas9(D10A)-SunTag (SEQ ID NO:137); a plasmid encoding a guide RNA with a spacer sequence corresponding to SEQ ID NO:131, a plasmid encoding SunTag-compatible forms of adenine deaminase, where the enzyme is fused to a single chain antibody that binds to SunTag (scFv) and a solubility tag (GB1); scFv-TadA8.20m-GB1 or scFv-TadA8e-GB1; and a plasmid encoding a glycosylase. The glycosylase was not actively recruited, but was expressed in the cell at the same time as the Cas9 and deaminase. For each plasmid, the protein coding sequence was flanked by a N-terminal NLS having a sequence of SEQ ID NO:129 and C-terminal NLS having a sequence of SEQ ID NO:130.

After three days, the editing efficiency was measured by high throughput sequencing of targeted loci. FIGS. 10 and 11 show the editing efficiency of target adenines in the base editing window to cytosine and thymine bases for scFv-TadA8.20m-GB1 and scFv-TadA8e-GB1, respectively. As can be seen in FIGS. 10 and 11, the use of enCas9(D10A)-SunTag (SEQ ID NO:137) can result in increased conversion of A to C or T compared to the use of nCas9(D10A)-SunTag (SEQ ID NO:136).

Example 12: Truncation of Inosine Glycosylase Regulatory Domain

Methylpurine glycosylase (MPG) usually contains two domains. The catalytic domain of MPG is necessary for excising inosine from DNA (Hollis, Lau, Ellenberger. Mutation Research 2000, 460, 201-210). Without being bound to any particular theory, in an effort to reduce the size of MPG, potentially allow for better inosine access to the catalytic domain, and potentially improve the solubility of the fusion complex, the N-terminus of MPG was truncated.

Figure 12:
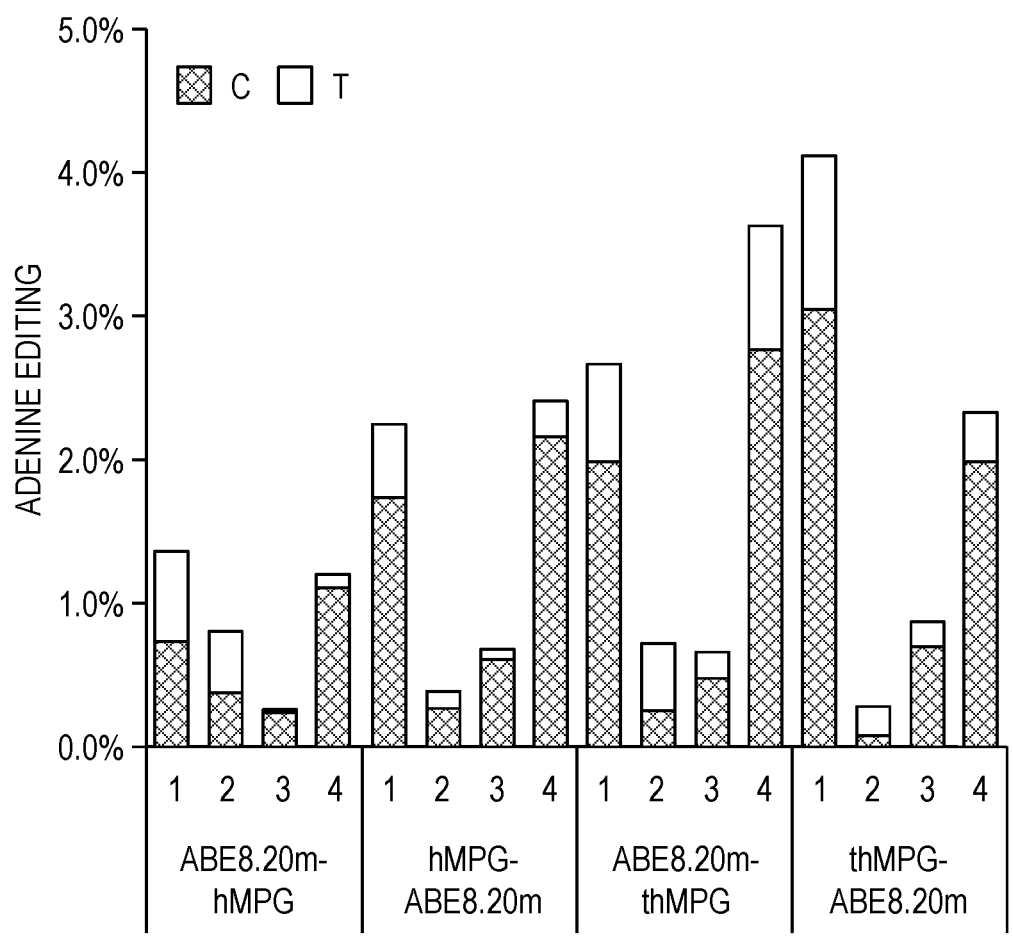
FIG. 12 is a graph showing that truncation of MPGs does not reduce A to C or T activity and can enhance efficiency.

In this experiment, both N-terminus and C-terminus fusions of hMPG to ABE8.20m (SEQ ID NO:57) were tested with a truncated variant of hMPG (thMPG) (SEQ ID NO:85). Four different target nucleic acids were tested, which were: Site 1: GAACACAAAGCATAGACTGC (SEQ ID NO:131), Site 2: GTCATCTTAGTCATTACCTG (SEQ ID NO:132), Site 3: GCACAACCAGTGGAGGCAAG (SEQ ID NO:133), and Site 4: GCTCCAGAGCCGTGCGAATG (SEQ ID NO:134). Across the four different sites, for both forms of fusion editors, there was no observed decrease in activity and, in some cases, there was an observed increase in adenine conversion to C or T (FIG. 12).

Figure 13:
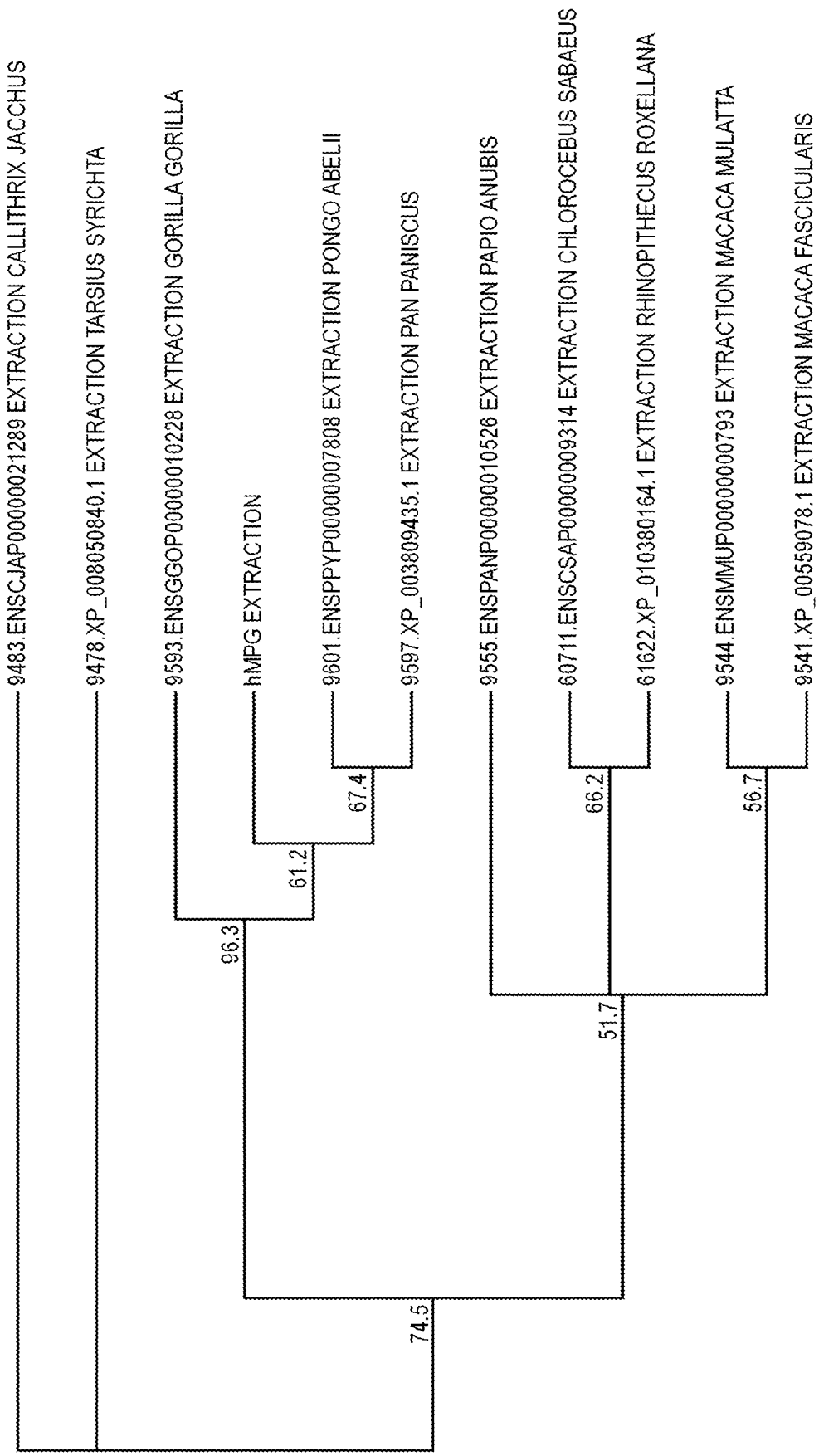
FIG. 13 is an illustration showing hMPG homologs identified by an amino acid similarity search.
Figure 14:
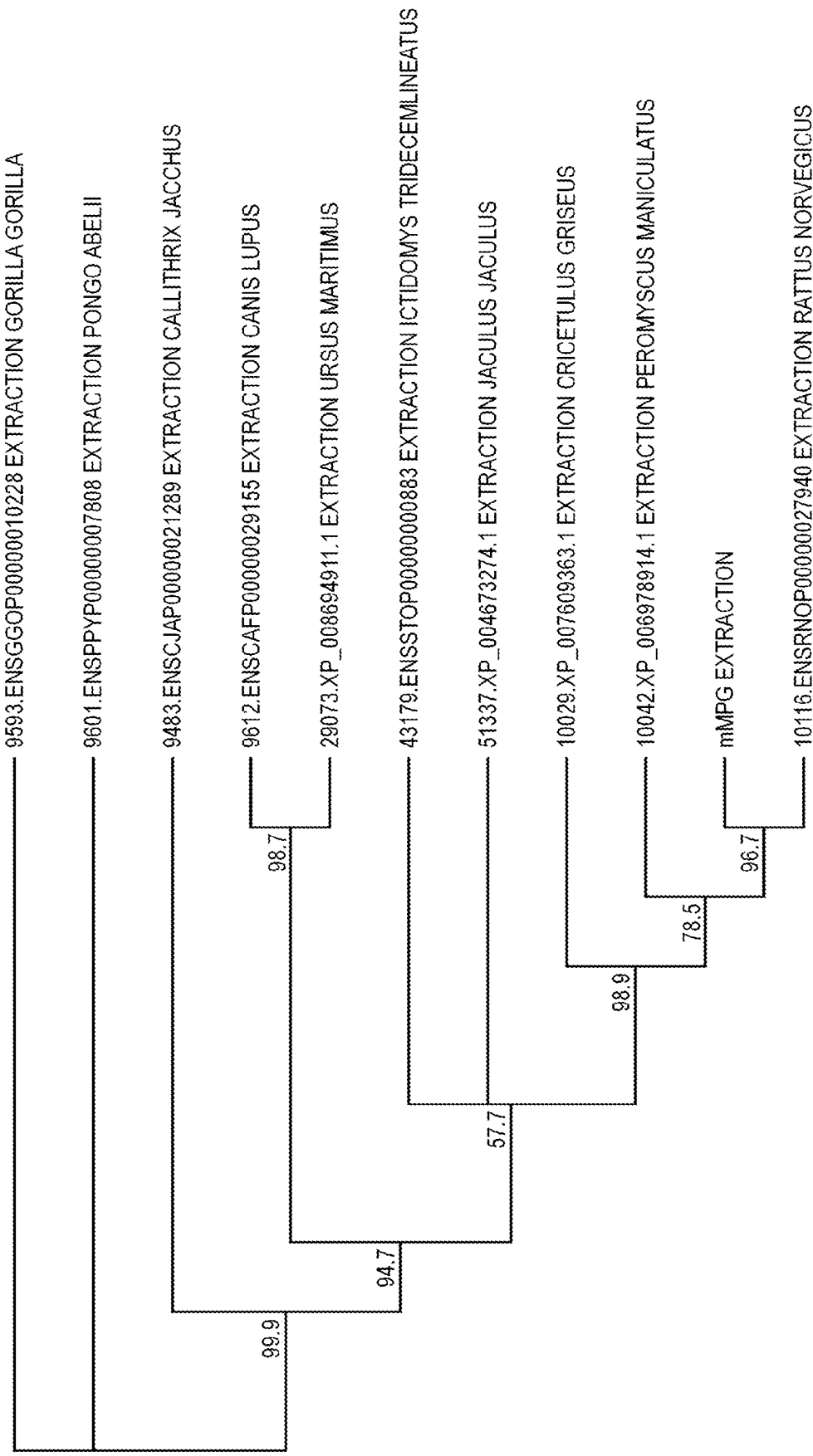
FIG. 14 is an illustration showing mMPG homologs identified by an amino acid similarity search.
Figure 15:
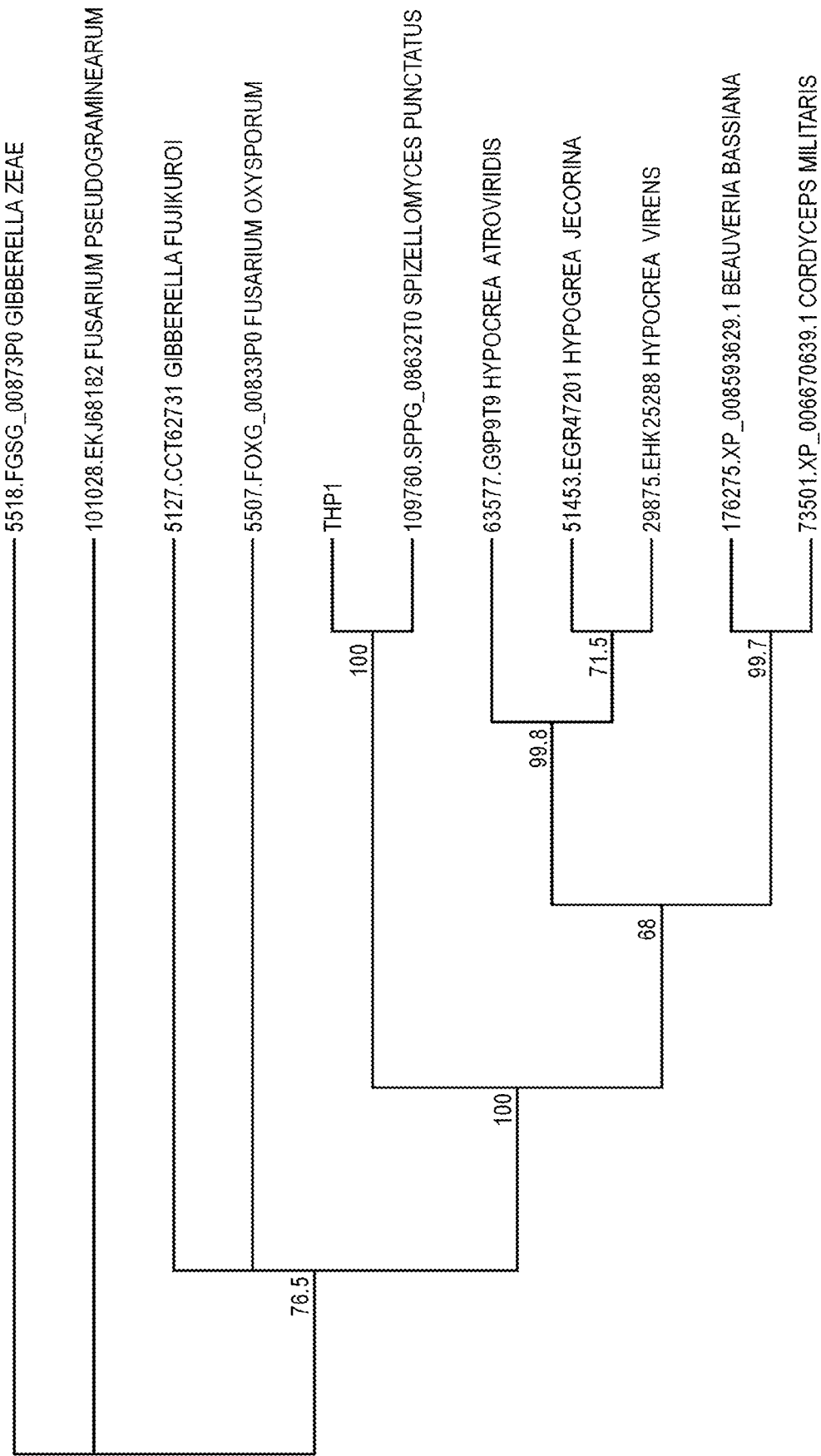
FIG. 15 is an illustration showing SpThp1 homologs identified by an amino acid similarity search.

Example 13: Bioinformatic Inosine Glycosylase Homolog Identification and Homolog Testing Databases were searched for proteins that are phylogenetically similar to hMPG, mMPG, and SpThp1. Ten genes that are the most similar to hMPG, mMPG, and thMPG are mapped to respective phylogenetic trees in FIGS. 13-15. Two genes from each tree, one very similar to queried MPG and another one more distant from it, were selected and cloned as an adenine diversifier. Only the catalytic domain was cloned (as truncated form). The organisms and their abbreviation are as follows: Gz=*Gibberella zeae*, Cj=*Callithrix jacchus*, Pa=*Pongo abelii*, Cl=*Canis lupus*, Cg=*Cricetulus griseus*, and Spu=*Spizellomyces punctatus*.

Truncated forms of CjMPG and PaMPG, termed tCjMPG (SEQ ID NO:88) and tPaMPG (SEQ ID NO:89), were selected from the hMPG phylogenetic tree. Similarly, truncated forms of CgMPG, tCgMPG (SEQ ID NO:86), and ClMPG, tClMPG (SEQ ID NO:87), were selected from the mMPG phylogenetic tree. GzThp1 (SEQ ID NO:91) and SpuThp1 (SEQ ID NO:90) were selected from the SpThp1 phylogenetic tree. Because SpThp1 did not have significant homology between it and hMPG or mMPG, domain assignment for Thp1 variants are generally unclear. Therefore, Thp1 variants were selected and fused to ABE8e (SEQ ID NO:56) without truncation. The truncated MPGs were also fused to ABE8e. For each of the fusions, an inosine glycosylase was fused to the C-terminus of ABE8e with a linker in between having a sequence of SEQ ID NO:121. In the plasmid, the protein coding sequence was flanked by a N-terminal NLS having a sequence of SEQ ID NO:129 and C-terminal NLS having a sequence of SEQ ID NO:130.

Figure 16:
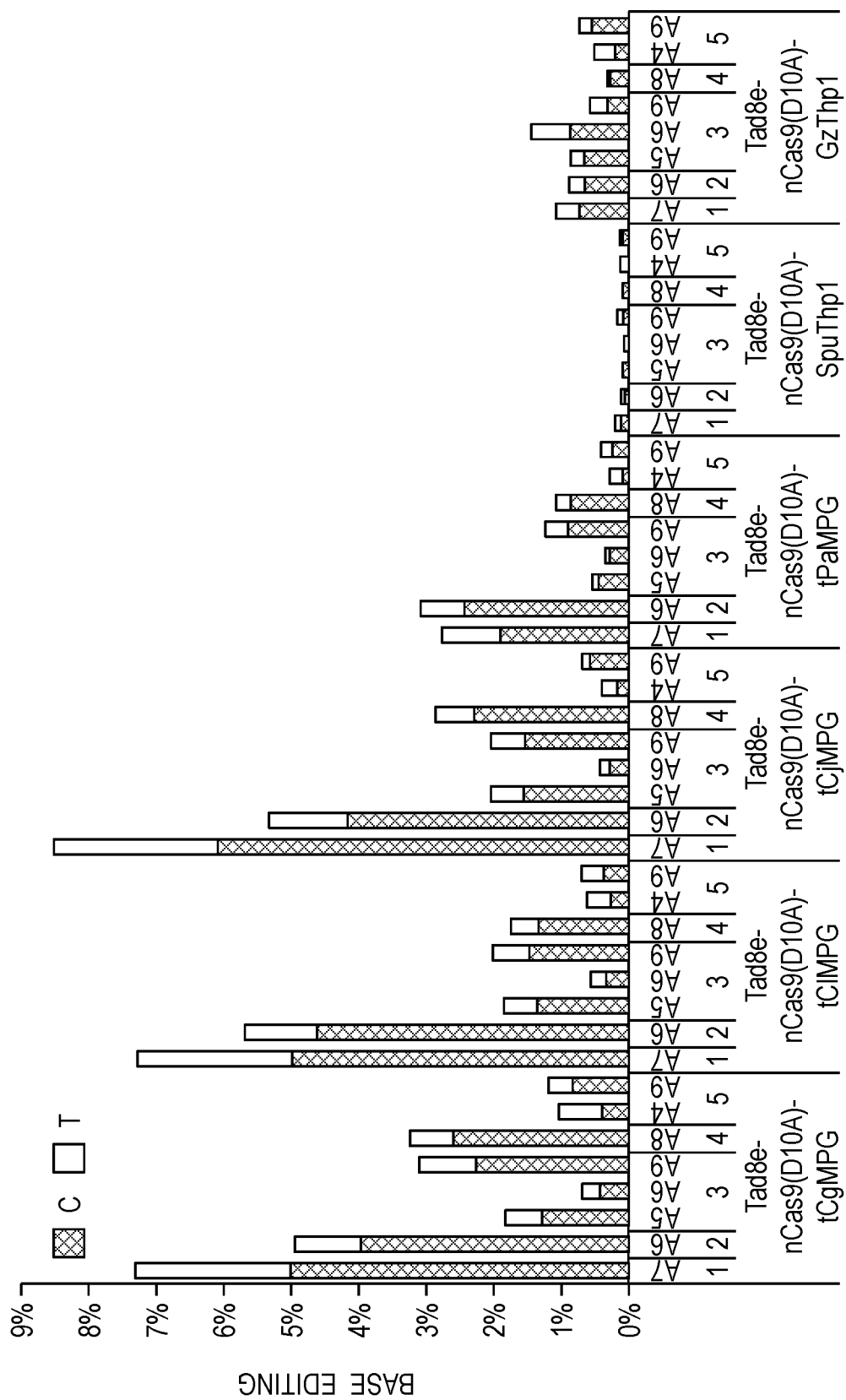
FIG. 16 is a graph showing percentage of base editing at Sites 1-5 for various adenine diversifiers that include a glycosylase according to some embodiments of the present invention.

Robust editing of adenine base into C or T bases was observed as shown in FIG. 16 (A to G conversion not shown; on average about 20-30% of total reads are A to G conversion). Several MPGs contributed to high editing efficiency.

Adenine diversifiers with CgMPG, ClMPG, CjMPG displayed the highest activity across multiple different target nucleic acids tested, which were: Site 1: GAACACAAAGCATAGACTGC (SEQ ID NO:131), Site 2: GCTCCAGAGCCGTGCGAATG (SEQ ID NO:134), Site 3: GCACAACCAGTGGAGGCAAG (SEQ ID NO:133), Site 4: GTGTTCCAGTTTCCTTTACA (SEQ ID NO:140), and Site 5: GTCATCTTAGTCATTACCTG (SEQ ID NO:132). Adenine diversifiers with SpThp1 homologs displayed lower efficiency but still had detectable activity (FIG. 16).

Example 14: Cas12a ABD Activity

Adenine diversification activity was demonstrated using a Type V CRISPR system, Cas12a. Deactivated LbCas12a, dLbCas12a (also known as dLbCpf1; SEQ ID NO:3), was fused to TadA8e (SEQ ID NO:60) on its N-terminus to provide a fusion, TadA8e-dLbCpf1, having the sequence of SEQ ID NO:141. Then, an inosine glycosylase was fused to the fusion protein at either its N-terminus or C-terminus. mMPG (SEQ ID NO:83), thMPG (truncated hMPG; SEQ ID NO:85), and SpThp1 (SEQ ID NO:79) were the inosine glycosylases tested. For C-terminal fusions, an inosine glycosylase was fused to the C-terminus of TadA8e-dLbCpf1 with a linker in between having a sequence of SEQ ID NO:121. For N-terminal fusions, an inosine glycosylase was fused to the N-terminus of TadA8e-dLbCpf1 with a linker in between having a sequence of SEQ ID NO:122. A fusion of TadA8.20m-dLbCpf1 having a sequence of SEQ ID NO:142 was used for comparison. For each plasmid, the protein coding sequence was flanked by a N-terminal NLS having a sequence of SEQ ID NO:129 and C-terminal NLS having a sequence of SEQ ID NO:130.

Editing was tested for three different target nucleic acids, which were: pwsp143: GCTCAGCAGGCACCTGCCTCAGC (SEQ ID NO:143), pwsp286: ATATAATGCATAATAAAAAACTT (SEQ ID NO:144), and pwsp453: TATGAGTTACAACGAACACCTCA (SEQ ID NO:145). The results for the pwsp143, pswsp286, and pwsp453 target sites are provided in FIGS. 17-19, respectively.

Figure 17:
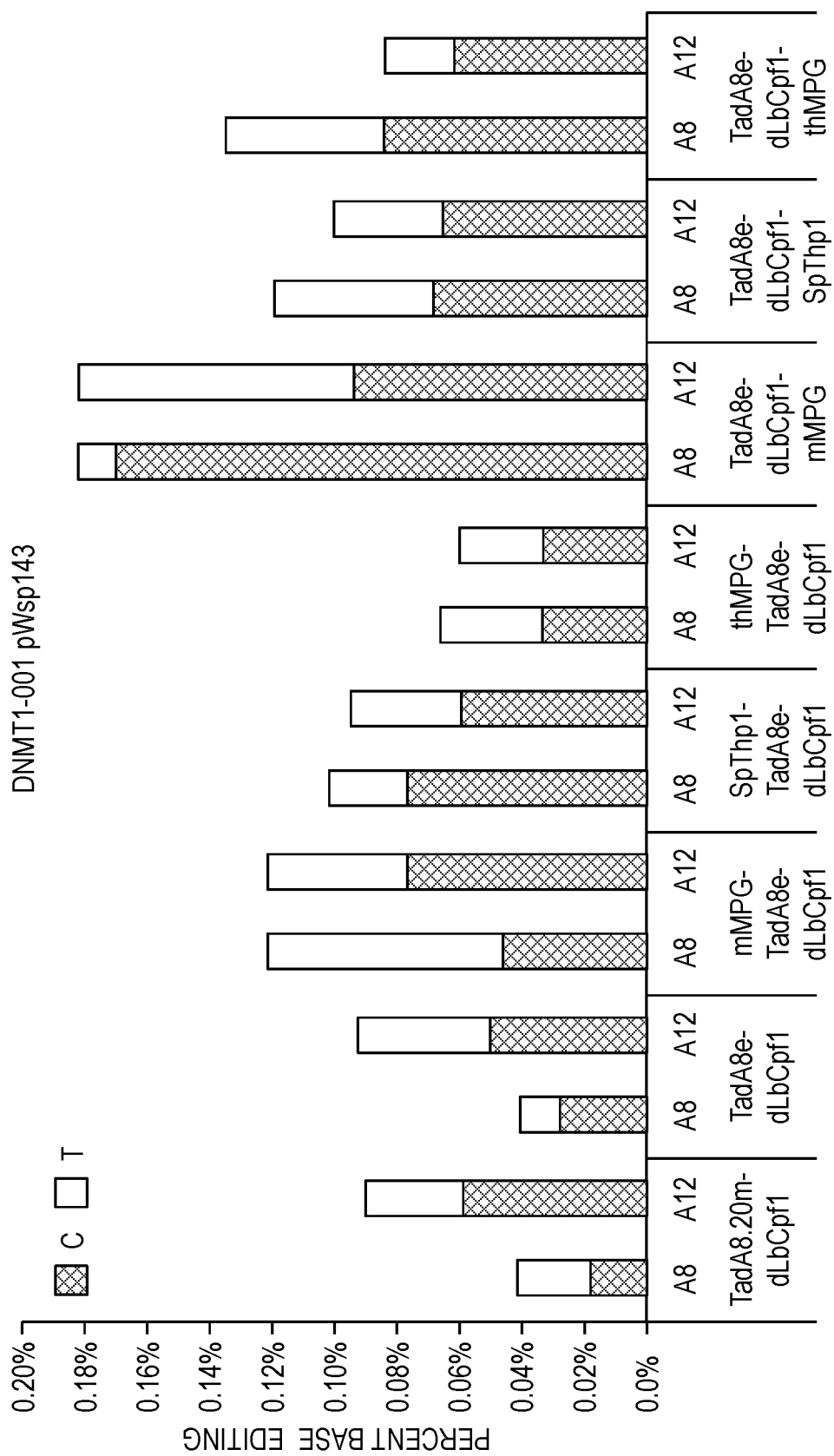
FIGS. 17-19 are graphs showing the base editing results for the pwsp143, pswsp286, and pwsp453 target nucleic acids, respectively, according to some embodiments of the present invention.
Figure 18:
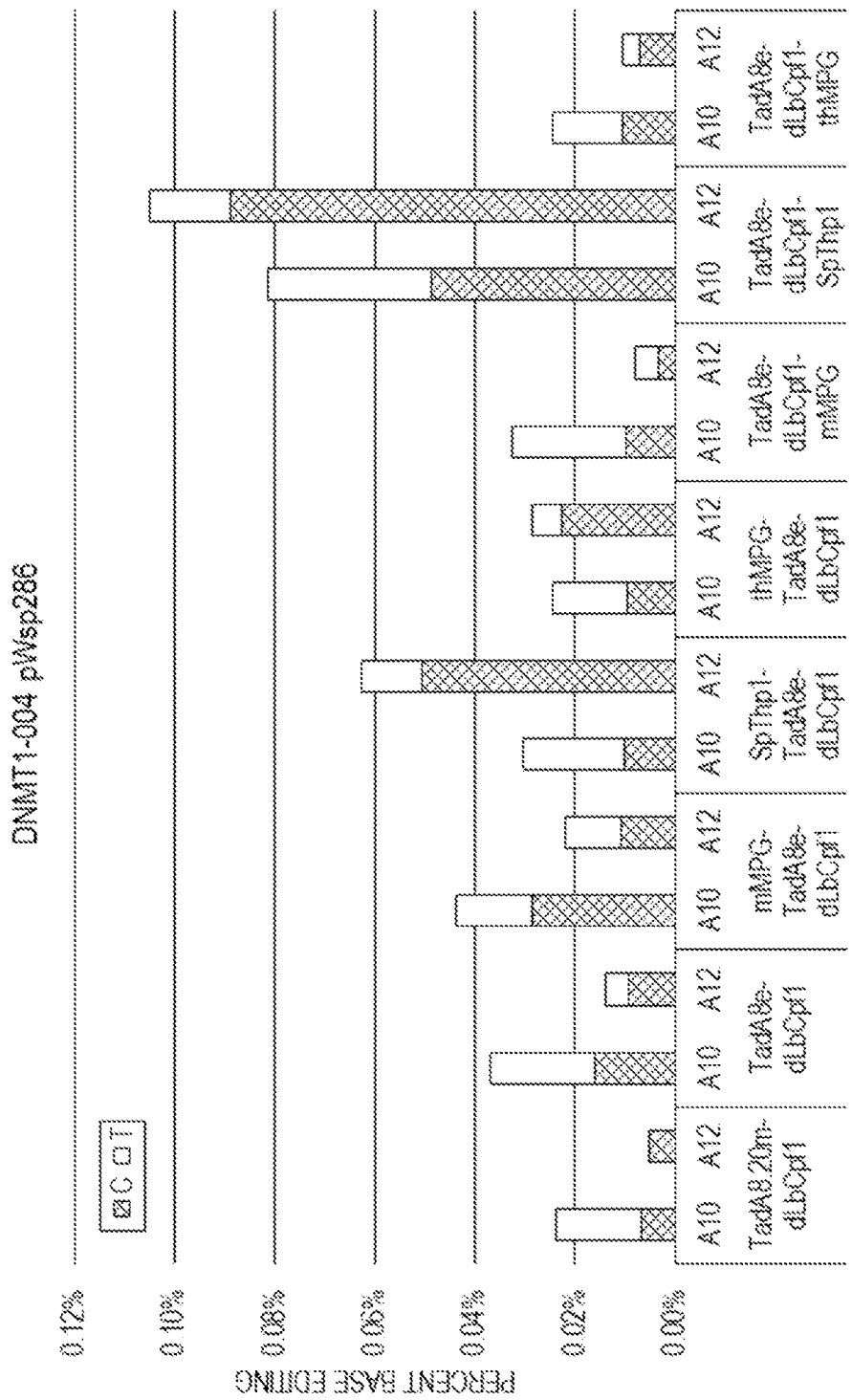
Figure 19:
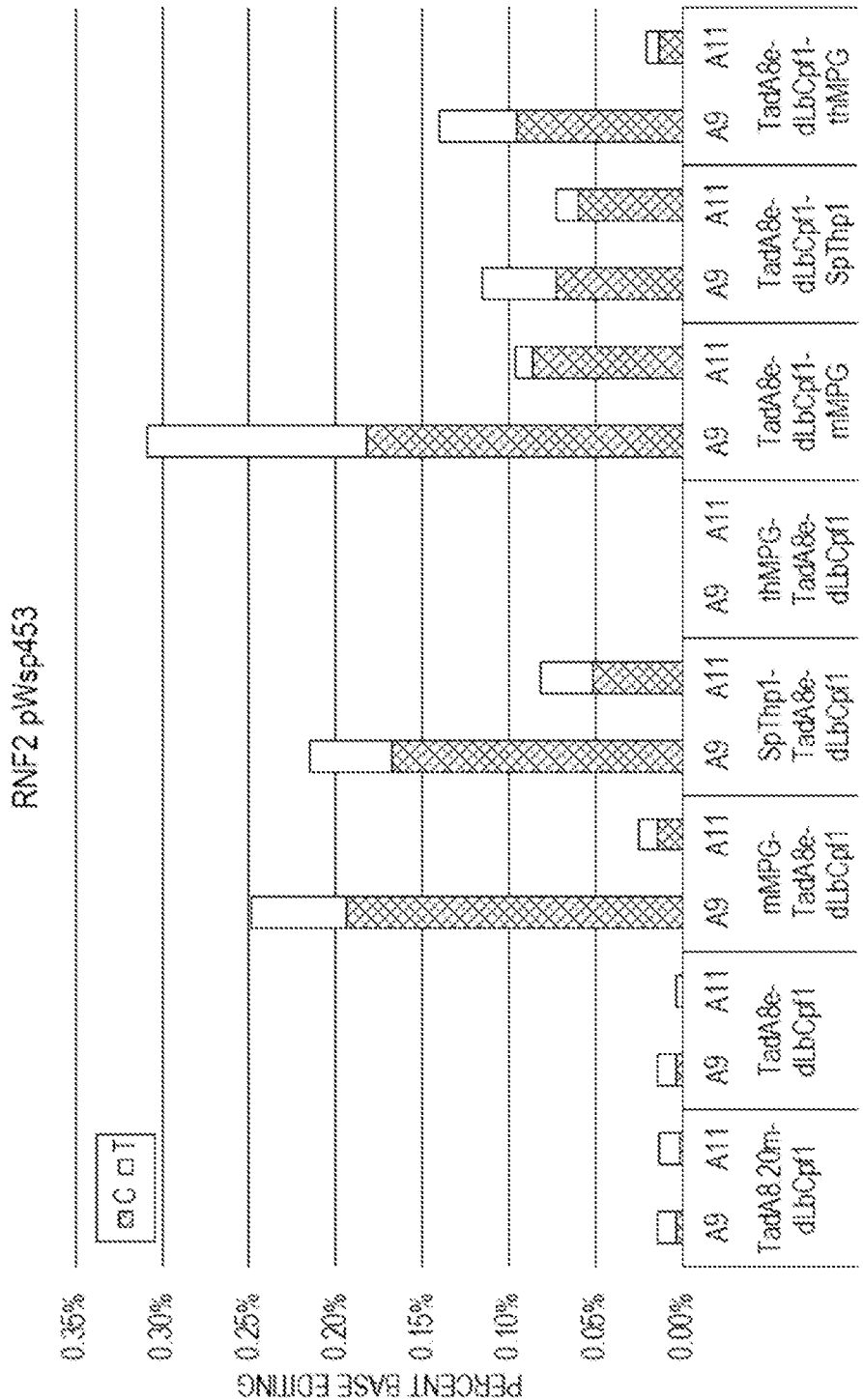

An increase in A to C or T mutagenesis was detected when inosine glycosylases were used to target bases in the target window (FIGS. 17-19). Proteins without inosine glycosylase had ~0.02% A to C or T conversion, whereas the presence of the glycosylase improved A to C or T conversion to 0.1-0.3% (FIGS. 17-19). A to G conversion is not shown. Typically ~2-3% of A to G conversion is observed.

Without being limited by any particular theory, these results demonstrate that exogenously provided inosine glycosylase can act on inosines generated from ABE treatment, which generates abasic sites, which are converted into DNA bases that are not accessible by ABE alone. Accordingly, transversion mutations can be achieved from the adenine starting base.

The foregoing is illustrative of the present invention, and is not to be construed as limiting thereof. The invention is defined by the following claims, with equivalents of the claims to be included therein.

SEQUENCE LISTING (283 sequences)

SEQ ID NO: 1 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 2 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 3 - protein, 1227 aa, Unknown
  Lachnospiraceae bacterium
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 4 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 5 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 6 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 7 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 8 - protein, 1300 aa, Francisella novicida U112
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 9 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 10 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 11 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 12 - protein, 1264 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 13 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 14 - protein, 1352 aa, Unknown
  Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 15 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 16 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 17 - protein, 1484 aa, Unknown
  Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 18 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 19 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 20 - DNA, 3987 bp, Artificial sequence
  Synthetic polynucleotide
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 21 - DNA, 3987 bp, Artificial sequence
  Synthetic polynucleotide
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 22 - DNA, 3987 bp, Artificial sequence
  Synthetic polynucleotide
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 23 - DNA, 4101 bp, Artificial sequence
  Synthetic polynucleotide
gacaagaagtacagcatcgggctggcgatcgggaccaactccgtcggctgggctgtgattaccgacgagtacaaggtgccatccaagaagttcaaggtcctcggcaacactgaccggcacagcattaagaagaacctgattggggcgctgctgttcgattcgggggagactgcggaggcgaccaggctgaagcggactgcgcgccggaggtacaccaggaggaagaatcggatctgctacctccaggagattttctcgaatgagatggccaaggtggacgattccttcttccatcgcctggaggagtcgttcctcgttgaggaggacaagaagcatgagaggcatcccattttcgggaatatcgttgacgaggtggcttaccatgagaagtacccgaccatctaccatctgcggaagaagctcgtcgattcgaccgataaggccgacctgcggctgatctacctggccctcgcgcacatgattaagttccggggccatttcctcatcgagggcgacctcaacccggacaactcggacgtggataagctcttcattcagctcgtgcagacatacaaccagctcttcgaggagaatcccattaacgcctcgggggtcgacgctaaggctattctctcggctcggctgtcgaagtcgcgccggctggagaatctcattgcccagctcccaggcgagaagaagaacggcctcttcggcaacctgattgccctgtcgctggggctcacaccgaatttcaagtcgaacttcgacctcgccgaggacgctaagctccagctcagcaaggatacttacgatgatgacctcgataacctgctcgcccagattggggatcagtacgcggatctgttcctcgcggccaagaatctcagcgatgctattctcctgtcggacattctccgcgtcaacacagagattactaaggccccactgtcggcgagcatgattaagaggtacgatgagcatcatcaggacctgacactgctcaaggcgctggtccggcagcagctccccgagaagtacaaggagattttcttcgatcagtcaaagaatgggtacgcgggctacattgatggcggcgcgtcccaggaggagttctacaagttcattaagcccatcctggagaagatggacgggaccgaggagctgctggtgaagctcaatcgggaggacctgctccggaagcagcgcacattcgacaatggctcgattcctcaccagattcacctgggcgagctgcacgccattctccgcaggcaggaggacttctacccgttcctcaaggacaaccgcgagaagatcgagaagatcctgaccttccggattccatactacgtggggccgctcgcgcgggggaactcccggttcgcgtggatgactcgcaagtccgaagaaacgattacaccgtggaatttcgaggaggtcgtcgacaagggcgctagtgcgcagtcattcattgagaggatgaccaatttcgataagaacctgcctaacgagaaggtgctgccgaagcattcgctgctctacgagtacttcaccgtttacaatgagctgaccaaggtgaagtatgtgactgagggcatgaggaagccagcgttcctgagcggcgagcagaagaaggctatcgtggacctgctcttcaagactaaccggaaggtgactgtgaagcagctcaaggaggactacttcaagaagattgagtgcttcgattccgttgagattagcggggtggaggatcggttcaatgcttcgctcgggacataccacgatctcctgaagatcattaaggataaggacttcctcgacaacgaggagaacgaggacattctcgaagatattgtcctgaccctcaccctcttcgaggatcgggagatgatcgaggagaggctcaagacatacgctcatctgttcgatgataaggtcatgaagcagctgaagcgcaggcggtacacagggtgggggcggctgagccggaagctgatcaacgggattcgggataagcagtccgggaagacaattctcgacttcctcaagtccgacgggttcgctaaccggaacttcatgcagctcattcatgatgactcgctgacattcaaggaggatattcagaaggcgcaggtttcggggcagggcgactcgctccacgagcatattgcgaatctggcgggctcccccgcgattaagaagggcattctgcaaaccgtcaaggtggttgatgagctggtcaaggtcatggggcggcataagccagagaatattgtcatcgagatggcgcgggagaatcagaccacacagaaggggcagaagaactcacgggagcggatgaagcgcatcgaggagggcatcaaggagctggggtcgcagatcctgaaggagcatcccgtggagaacactcagctgcaaaatgagaagctgtacctctactacctccagaacgggagggacatgtatgtggatcaggagctggatattaataggctgagcgattacgatgtcgaccacattgtcccacagtcgttcctgaaggacgacagcattgacaacaaggtgctgacccgctcggataagaacaggggcaagagcgataatgttccaagcgaggaggttgtgaagaagatgaagaactactggcggcagctcctgaacgcgaagctcatcacacagcggaagttcgacaacctcaccaaggctgagcgcgggggcctgagcgagctggacaaggcggggttcattaagaggcagctggtcgagacacggcagattacaaagcatgttgcgcagattctcgattcccggatgaacaccaagtacgatgagaacgataagctgattcgggaggtcaaggtaattaccctgaagtccaagctggtgtccgacttcaggaaggacttccagttctacaaggttcgggagatcaacaactaccaccacgcgcatgatgcctacctcaacgcggtcgtggggaccgctctcatcaagaagtacccaaagctggagtcagagttcgtctacggggattacaaggtttacgacgtgcggaagatgatcgctaagagcgagcaggagattggcaaggctaccgctaagtacttcttctactccaacatcatgaacttcttcaagacagagattaccctcgcgaatggcgagatccggaagaggcccctcatcgagacaaatggggagacaggggagattgtctgggataaggggcgggatttcgcgaccgtccggaaggtcctgtcgatgccccaggttaatattgtcaagaagactgaggtccagactggcggcttctcaaaggagtcgattctcccaaagaggaactccgataagctcattgctcggaagaaggattgggaccccaagaagtacgggggattcgactcccccactgttgcttactctgttctggttgttgctaaggtggagaaggggaagtcgaagaagctgaagagcgtgaaggagctgctcgggattacaattatggagaggtcatccttcgagaagaatcccatcgacttcctggaggccaagggctacaaggaggtgaagaaggacctgattattaagctgcccaagtactcgctcttcgagctggagaatgggcggaagcggatgctggcgtccgcgggggagctgcaaaaggggaacgagctggcgctcccctccaagtatgtgaacttcctctacctggcgtcgcactacgagaagctgaaggggtccccagaggataatgagcagaagcagctcttcgtcgagcagcataagcactacctggacgagattatcgagcagattagcgagttctcgaagcgggtcatcctcgcggatgcgaacctggataaggtgctcagcgcctacaataagcaccgggacaagccgattcgggagcaggcggagaatattattcacctcttcacactcaccaacctcggggcaccagctgcgttcaagtacttcgacactactatcgaccggaagcggtacacctcgacgaaggaggtgctcgacgccaccctcattcaccagtcgatcacaggcctgtacgagacacggattgacctgtcccagctcgggggcgac

SEQ ID NO: 24 - DNA, 4101 bp, Artificial sequence
  Synthetic polynucleotide
gacaagaagtactccattggcctggcgattgggacaaactcggtggggtgggccgtgattacggatgagtacaaggttccaagcaagaagttcaaggtcctcgggaacacagatcggcattcgattaagaagaatctcattggggcgctcctcttcgactcgggggagacagcggaggctaccaggctcaagcggacagccaggcggcggtacacaaggcggaagaatcgcatctgctacctccaggagattttctcgaatgagatggcgaaggtggacgacagcttcttccatcggctggaggagtccttcctggtggaggaggataagaagcacgagaggcatccaattttcgggaacatcgtggacgaggttgcgtaccatgagaagtaccctacaatctaccatctgcggaagaagctggttgactccacagacaaggcggacctgaggctgatctacctcgctctggcccacatgattaagttccgcgggcatttcctgatcgagggggacctgaatcccgacaattcggatgtggacaagctcttcatccagctggtgcagacctacaaccagctgttcgaggagaatcccatcaatgcgtcgggcgttgacgctaaggccattctgtccgctaggctgtcgaagagcaggaggctggagaacctgatcgcccagctgccaggcgagaagaagaatgggctcttcgggaatctgattgcgctctccctggggctgacaccgaacttcaagagcaatttcgatctggctgaggacgcgaagctccagctctcgaaggacacttacgacgatgacctcgataacctcctcgcgcagatcggggaccagtacgctgatctcttcctcgccgctaagaacctctcggatgctatcctgctctccgacattctccgggttaataccgagattacaaaggccccactgtcggcgtccatgatcaagcggtacgatgagcatcatcaggatctcaccctgctcaaggccctcgtgcggcagcagctgcccgagaagtacaaggagattttcttcgaccagagcaagaatgggtacgctggctacattgacggcggggcctcacaggaggagttctacaagttcatcaagccaatcctggagaagatggatgggacagaggagctgctggtgaagctcaaccgggaggatctgctcaggaagcagcggacgttcgacaacgggtcgattccccatcagatccacctgggggagctgcacgcgatcctgcgccggcaggaggatttctaccctttcctgaaggataatcgggagaagatcgagaagattctcaccttccggattccctactacgtcgggccactcgcgcggggcaatagcaggttcgcctggatgacacggaagagcgaggagacaatcaccccctggaacttcgaggaggttgtcgacaagggggcgtccgcccagtcattcattgagcggatgaccaatttcgacaagaatctgccaaatgagaaggttctcccaaagcatagcctcctctacgagtacttcactgtttacaacgagctgaccaaggtgaagtatgtgaccgagggcatgcggaagcccgcgttcctgtccggcgagcagaagaaggccattgtggacctcctgttcaagaccaatcgcaaggtcacagtcaagcagctcaaggaggattacttcaagaagatcgagtgcttcgactcggttgagattagcggggtggaggatcggttcaacgcgagcctcggcacttaccacgacctcctgaagatcatcaaggataaggacttcctcgacaacgaggagaacgaggatattctggaggacatcgtgctcaccctgacgctgttcgaggatcgggagatgatcgaggagcgcctgaagacctacgctcatctcttcgatgataaggtcatgaagcagctgaagaggaggcggtacaccgggtggggccgcctgagcaggaagctcattaacgggatcagggacaagcagagcggcaagaccatcctggacttcctcaagagcgatggcttcgccaaccggaatttcatgcagctcatccacgacgactccctcaccttcaaggaggacattcagaaggctcaggtcagcggccagggcgactcgctgcatgagcacatcgctaacctggcgggcagcccagccatcaagaagggcatcctccagacagtgaaggtcgtggatgagctggtgaaggtcatgggccggcataagcccgagaatattgtgattgagatggcgcgggagaatcagaccactcagaagggccagaagaactcgcgggagcgcatgaagaggatcgaggaggggattaaggagctgggcagccagattctcaaggagcaccccgtggagaatacccagctccagaacgagaagctgtacctctactacctccagaatgggcgggacatgtatgttgatcaggagctggacatcaatcgcctctcggattacgacgtggaccacatcgtgccccagagcttcctgaaggatgatagcatcgacaataaggtcctgacccgctccgacaagaatcgcggcaagagcgacaacgtgccgagcgaggaggtcgtgaagaagatgaagaactactggcggcagctgctgaacgcgaagctcattacacagcggaagttcgataacctgacgaaggcggagaggggcggcctctccgagctggacaaggcgggcttcattaagaggcagctcgtggagactcgccagatcaccaagcacgtggctcagatcctcgatagccggatgaatacgaagtacgatgagaatgacaagctcatccgggaggtgaaggtaatcaccctgaagtcaaagctcgttagcgatttccggaaggacttccagttctacaaggtgcgggagattaacaactaccatcatgcgcacgatgcgtacctcaatgcggtggtgggcacagccctgattaagaagtaccccaagctggagagcgagttcgtctacggggactacaaggtgtacgatgttcggaagatgatcgccaagagcgagcaggagattgggaaggccaccgctaagtacttcttctactcgaatattatgaatttcttcaagaccgagatcacactcgctaatggggagattcggaagcggcccctcatcgagactaacggggagactggcgagattgtgtgggacaaggggcgcgacttcgctaccgtgcgcaaggtcctctcgatgccccaggttaatattgttaagaagacagaggtgcagacgggcgggttctccaaggagtctatcctgccgaagcggaactcggacaagctgatcgcccgcaagaaggattgggaccccaagaagtacgggggattcgatagcccaaccgtggcttacagcgtcctggtggtcgccaaggttgagaaggggaagtcgaagaagctcaagagcgttaaggagctgctgggcatcaccatcatggagcggtccagcttcgagaagaatcctatcgacttcctggaggctaaggggtacaaggaggtcaagaaggacctgatcattaagctgcccaagtactctctgttcgagctggagaacgggaggaagcggatgctggcgtctgctggcgagctacagaagggcaatgagctggcgctcccctcgaagtatgtcaacttcctctacctggcttcccattacgagaagctgaagggctcgcccgaggataatgagcagaagcagctcttcgtggagcagcacaagcactacctcgacgagatcattgagcagatttcggagttctcgaagcgggtcattctcgcggacgcgaacctcgacaaggtcctctcggcgtacaacaagcaccgggacaagcccatccgggagcaggccgagaacattatccacctcttcacactgaccaacctcggcgctcccgccgcgttcaagtacttcgacaccaccattgaccgcaagagatacacatccaccaaggaggtgctggacgcgaccctcatccaccagagcatcacaggcctctacgagacacggatcgacctctcgcagctcgggggcgat

SEQ ID NO: 25 - DNA, 4092 bp, Artificial sequence
  Synthetic polynucleotide
gacaagaagtactcgatcggcctggcgattggcacaaacagcgtggggtgggctgtgatcactgatgagtacaaggtgccatcgaagaagttcaaggtgctggggaatacagaccggcattcgatcaagaagaatctcattggcgctctcctcttcgattccggcgagactgctgaggcgacccgcctgaagcgcaccgcccggcggcgctacactcggcggaagaataggatttgctacctccaggagattttctcgaatgagatggccaaggtggatgacagcttcttccaccgcctggaggagtcgttcctggtcgaggaggacaagaagcatgagcggcaccctatcttcgggaatatcgttgatgaggtcgcctaccacgagaagtaccccactatctaccatctccgcaagaagctcgtggacagcacagataaggccgacctccgcctgatctacctcgccctcgcgcacatgattaagttccgggggcacttcctcattgagggggatctgaatcccgataactccgacgtggacaagctgttcatccagctggtgcagacatacaaccagctgttcgaggagaatcccatcaacgcgagcggcgtggacgctaaggccattctgtcggctaggctctcgaagtcgaggcggctggagaacctgattgcgcagctccccggcgagaagaagaacgggctgttcgggaatctcatcgccctctccctcggcctcacaccaaacttcaagagcaatttcgacctggctgaggacgctaagctgcaactctcaaaggatacatacgatgacgacctggacaatctcctggctcagatcggcgaccagtacgctgacctgttcctcgcggccaagaatctgtcggacgcgattctcctcagcgacatcctgcgcgtcaataccgagattacgaaggctccactgtctgcgtcaatgattaagcggtacgatgagcatcaccaggatctgaccctcctgaaggcgctcgtgcggcagcagctgcccgagaagtacaaggagattttcttcgatcagagcaagaatggctacgccggctacatcgacgggggcgcgagccaggaggagttctacaagttcatcaagcccatcctggagaagatggacggcaccgaggagctactcgtgaagctcaatcgggaggatctcctccggaagcagcggacattcgataacgggtctatcccacaccagatccacctcggcgagctgcatgcgattctgcggcggcaggaggatttctaccctttcctgaaggacaaccgggagaagatcgagaagatcctcacattccggattccatactacgtcggccccctggcgaggggcaatagccggttcgcgtggatgacaaggaagtccgaggagactattaccccgtggaatttcgaggaggtggttgacaagggcgcttccgcgcagagcttcattgagcggatgacaaacttcgacaagaatctccccaacgagaaggtcctgccgaagcatagcctcctgtacgagtacttcaccgtctacaatgagctaactaaggtcaagtatgtgacagagggcatgaggaagccagccttcctctcaggcgagcagaagaaggccattgtggacctcctgttcaagacaaaccgcaaggtgacagtgaagcagctgaaggaggattacttcaagaagattgagtgcttcgactcagtggagatttcaggcgtggaggatcggttcaacgcgagcctggggacttaccacgacctgctgaagattattaaggacaaggacttcctggataacgaggagaatgaggacatcctggaggatattgtgctcaccctcaccctgttcgaggacagggagatgattgaggagaggctcaagacctacgcgcacctgttcgatgacaaggtcatgaagcagctgaagaggcggcgctacactgggtggggccgcctgtcgcggaagctgatcaacggcattcgggataagcagtccgggaagaccattctggatttcctgaagtcggacggcttcgccaacaggaatttcatgcagctgatccacgacgactccctcaccttcaaggaggacattcagaaggcccaggttagcggccagggggactcactccacgagcatattgccaatctggccggctctccagctatcaagaagggcatcctgcaaacagttaaggttgttgacgagctggttaaggtcatggggcggcataagcccgagaacattgtcatcgagatggctcgggagaaccagacaactcagaagggccagaagaactccagggagcgcatgaagcggattgaggagggcattaaggagctggggtcccagatcctcaaggagcaccctgtcgagaacactcagctgcaaaacgagaagctctacctgtactacctccagaacgggcgggatatgtatgtggatcaggagctggacatcaacaggctctccgactacgacgtggatcacattgtcccacagtctttcctcaaggatgattccatcgacaacaaggtgctgacgcgcagcgacaagaatagggggaagtcggacaacgttccgagcgaggaggtcgtgaagaagatgaagaattactggaggcagctcctgaatgcgaagctgatcactcagaggaagttcgacaatctgacaaaggcggagaggggcgggctctcggagctggataaggcgggcttcatcaagcggcagctcgttgaaacccggcagatcaccaagcatgtcgcccagatcctcgatagccgcatgaacaccaagtacgatgagaacgacaagctcattcgggaggttaaggtcattacgctgaagtccaagctcgtcagcgacttcaggaaggatttccagttctacaaggttcgggagattaacaactaccaccacgcgcatgatgcgtacctgaacgctgttgtcggcactgctctcatcaagaagtacccaaagctggagtccgagttcgtctacggggactacaaggtctacgatgtccggaagatgatcgccaagtcggagcaggagatcgggaaggctactgcgaagtacttcttctacagcaacattatgaatttcttcaagacggagattacgctggcgaacggggagattaggaagaggcccctcattgagactaatggggagacaggcgagattgtttgggacaagggccgcgacttcgcgactgtgcggaaggtcctgtccatgccacaggtgaatattgttaagaagacagaggtgcagactgggggcttctcgaaggagagcattctcccaaagcggaacagcgataagctcatcgcgcgcaagaaggattgggaccctaagaagtacggcggcttcgattctcccactgtggcctactccgttctcgtggttgccaaggttgagaaggggaagtcgaagaagctgaagtcggtcaaggagctgctcgggattacaatcatggagcggagcagcttcgagaagaaccctattgatttcctggaggccaagggctacaaggaggttaagaaggatctcattatcaagctccctaagtactctctgttcgagctggagaatggccggaagaggatgctggcctcggctggcgagctacagaaggggaatgagctggccctcccgtcgaagtatgtgaatttcctgtacctcgcgtcgcactacgagaagctcaagggcagcccggaggataatgagcagaagcagctcttcgtggagcagcataagcactacctggacgagatcattgagcagatcagcgagttctcgaagcgggttattctggctgatgctaacctggacaaggttctgagcgcctacaataagcatcgcgacaagccgattcgcgagcaggcggagaatattatccacctgttcaccctcactaacctcggggctcccgcggccttcaagtacttcgataccacaatagataggaagcggtacacctcgacgaaggaggtcctcgacgccacactcatccatcagtcgattacaggcctgtacgagacacggattgacctctcgcagctg

SEQ ID NO: 26 - DNA, 4101 bp, Artificial sequence
  Synthetic polynucleotide
gacaagaagtattccataggcctggctatcggcaccaacagcgtgggctgggccgtcatcaccgacgagtacaaagtgccgagtaaaaagttcaaagtgctcggcaacaccgaccgccactccataaagaaaaacctgatcggggcgctcctgttcgacagcggcgagacggcggaggccacccgcttgaaacgcacggcccgacggcgctacacgcggcgcaagaaccggatctgttacctacaggagattttctctaacgagatggcgaaggtggacgactcgttctttcaccgcctcgaagagtccttcctcgtggaggaggacaagaaacacgagcgccacccgatcttcggcaacatcgtggacgaggtggcctaccacgagaagtacccgaccatctaccacctccggaagaaactcgtggacagcacggacaaggccgacctgaggctcatctacctcgccctggcgcacatgattaagttccggggccacttcctgatcgagggcgacctgaacccggacaacagcgacgtggacaagctgttcatccagctagtccagacctacaaccagcttttcgaggaaaaccccatcaacgccagcggggtggacgcgaaggcgatcctgtccgcccggctgagcaagtcccggcggctggagaacctcatcgcgcagttgcccggcgagaagaagaacgggctgttcgggaacctgatcgccctctccctggggctcaccccgaacttcaagtccaacttcgacctcgccgaggacgccaaactacagctgagcaaggacacctacgacgacgacctcgacaacctgctggcccagatcggggaccagtacgcagacctgttcctcgccgccaagaacctctccgacgccatcctgctgtcggacatcctgcgggtgaacacggagatcacgaaggccccgctctcggcctcgatgattaaacgctacgacgagcaccaccaggacttgaccctcctcaaggcgctggtccgccagcagcttcccgagaagtacaaggaaatctttttcgatcagagcaagaacgggtacgccgggtacatcgacggcggggcgtcccaggaggagttctacaagttcatcaagcccatcctggagaaaatggacgggaccgaggagctgctcgtgaagctcaaccgcgaagatttgctccgcaagcagcgcacgttcgacaacgggtcgatcccgcaccagatccacctgggcgagctgcacgcgatcctcaggcgtcaggaagacttctaccccttcctcaaggacaaccgcgagaagatagagaagattctgaccttcagaattccttattacgtgggcccgctggctcggggcaactcgcgcttcgcctggatgacgcgcaagtccgaggagaccatcaccccgtggaacttcgaggaggtggtggataagggtgcctcggcccagtccttcatcgagcggatgaccaacttcgacaagaacctgccgaacgagaaggtgctccccaagcacagcctgctctacgaatatttcacggtgtacaacgagctgacgaaggtcaagtacgtgaccgagggaatgaggaaacctgcattcctctccggggagcagaagaaagccatagtcgacctcctgttcaagaccaaccggaaggtcaccgtcaagcagctcaaggaggactacttcaagaagatcgagtgcttcgattcagtggagatcagcggcgtcgaggaccggttcaacgccagcctgggcacctaccacgacctgctcaagatcatcaaggacaaggacttcctcgacaacgaggagaacgaggacatcctggaggacatcgtgctgaccctgacgctcttcgaggaccgcgagatgatcgaggagcgcctcaagacctacgcccacctgttcgacgacaaggtgatgaagcagctcaagcggcggagatatactgggtggggccgcctctcccggaagctcattaacggtatcagggataagcagtccgggaagacgatcctcgacttcctcaagtcggacgggttcgccaaccgcaacttcatgcagctcatccacgacgactccctgacgttcaaggaggacatccagaaggcccaagtgtctggtcaaggtgactcgctccacgagcacatcgccaacctcgcgggcagcccggccatcaagaagggaatactccagaccgtcaaggtggtggacgagctggtgaaggtcatgggccgccacaagccggagaacatcgtcatcgagatggcgcgggagaaccagaccacgcagaaggggcagaaaaatagccgtgagcgcatgaagcgcatcgaggaggggattaaggagttgggcagccagatcctcaaggagcaccctgtggagaacacgcagttgcaaaacgagaagctctacctgtactacctccagaacgggagggatatgtacgtggaccaagaactggacatcaaccgcctgtccgactacgacgtggaccacatcgtgccgcagagcttcctcaaggacgacagcatcgacaacaaggtgctcacccggtccgacaagaatcggggcaagtccgacaacgtgcccagcgaggaggtcgtcaaaaagatgaaaaactactggcgacaactactgaacgccaagctcatcacccagcgcaagttcgacaacctcacaaaagccgagcgcggcgggttgagcgagctggacaaggccgggttcatcaagcgccagctcgtcgagacgcgccagatcacgaagcacgtcgcgcagatactcgacagccggatgaacaccaagtacgacgagaacgacaagctcatccgggaggtgaaggtcatcaccctcaagtcgaagctcgtgagcgacttccgcaaggacttccagttctacaaggtccgggagatcaacaactaccaccacgcccacgatgcttatcttaacgccgtggtggggacggccctcattaagaaatacccgaagctggagtcggagttcgtgtacggcgactacaaggtgtacgacgtcaggaagatgatcgccaagtccgaacaggagatcgggaaggccacggcgaaatacttcttctacagcaacatcatgaacttcttcaagaccgagatcaccctcgccaacggcgagatccgcaagcgcccgctcatcgagacgaacggggagaccggcgagatcgtctgggacaaggggcgcgacttcgccactgtgcggaaggtgctgtcgatgccccaggtcaacatcgtcaagaagacggaggtccagacgggcgggttcagcaaggagagcatcctgccgaagcgcaacagcgacaagctgatcgcccgcaaaaaggactgggatccaaaaaagtacggcggcttcgacagccccaccgtcgcctacagcgtcctcgtcgtcgctaaagtcgagaagggcaagtccaaaaagctcaagagcgtcaaggagctgctcgggatcaccatcatggagcggtccagcttcgagaagaacccaattgatttcctggaggcgaagggctacaaggaggtcaagaaagacctcatcataaagctgccgaagtactcactcttcgagctggagaacgggcgcaagcggatgctggcgtcggccggagagctccaaaagggcaacgagctggcgctgccgagcaagtacgtgaacttcctctacctggcgtcccactacgagaagctcaagggcagtccagaggataacgagcagaagcagctattcgtggagcagcacaagcactacctggacgagatcatcgagcagatcagcgagttctccaagcgcgtcatcctggcggacgccaacctggacaaggtgctgtccgcgtacaacaagcaccgcgacaagccgatccgcgagcaagccgagaacatcatccacctgttcaccctcacgaacctcggggcacccgccgccttcaaatatttcgacacgaccatcgaccgcaagcgctacaccagcacgaaggaggtgctcgacgccaccctgatccaccagagcatcaccgggctgtacgagacccgcatcgacctctcgcagctcggcggggac

SEQ ID NO: 27 - DNA, 4101 bp, Artificial sequence
  Synthetic polynucleotide
gacaagaagtacagtattggattggccatcgggacgaacagcgtgggctgggccgtcatcaccgacgagtacaaggtgccatccaagaagtttaaggttctggggaataccgaccgccactcgatcaagaaaaatctcatcggggcgctgcttttcgacagcggcgagacggcggaagcgacgcggctcaagcggacggctcgtcgccgttacacccggcgtaagaaccgcatctgttacctccaggagatattcagcaacgagatggcgaaggtggacgactcctttttccaccgtcttgaggagtccttcctggtcgaggaggacaagaagcacgagcgccacccgatcttcgggaacatcgtggacgaggtggcctaccacgagaagtaccccacgatctaccacctccgcaaaaaactcgtggactcaactgacaaggccgatttgaggcttatctacctcgccctcgcccacatgattaagttccgtgggcacttcctaatcgagggtgacctcaaccccgacaactctgacgtggacaagctgttcatccagcttgtgcagacctacaatcagctctttgaggagaatccgatcaacgcatctggtgtggacgcaaaggccatcctcagcgcgcggctgagcaagtctaggcggttggagaacctgatcgcccaactgcccggcgagaagaaaaatggcctcttcggcaacctgatcgccctgtcgctggggctcacgccgaacttcaagagtaactttgacctggcggaggacgctaagctccagctatctaaggacacatacgacgacgacctggacaacctgctggcccagatcggcgaccagtacgccgacctcttcctagccgccaagaacctgtccgacgccatcctcctcagcgacatcctgcgcgtgaacacggagatcacgaaggctccgctcagcgcctccatgattaagcggtacgacgagcaccaccaagacctaactttactcaaagccctcgtgcggcagcagcttcccgagaagtacaaagagatattttttgatcagtccaagaacggttatgcgggctacatcgacggcggcgcgagccaggaggagttctacaagttcatcaagcccatcctggagaagatggacggcacggaggagctgctcgtgaagctcaaccgtgaagacctcctgcgaaagcagcgaaccttcgacaacggttcgatcccgcaccagatccacctcggggagctgcacgccatcctgaggcgacaggaggacttctaccctttcctaaaggacaaccgcgagaagattgaaaaaatcctgacgtttcgcataccctactacgtcggcccgctggcgcgcggcaactcccggttcgcctggatgacccgtaagagcgaggagacgatcaccccgtggaacttcgaggaggtcgtggacaagggcgcgagcgcgcagagcttcatcgagcgcatgaccaacttcgacaagaacctcccgaacgagaaggtgctcccaaagcactccctcctgtacgagtatttcaccgtgtacaacgagttgacaaaggtgaagtacgtgacggagggaatgcggaagcctgcgttcctctcgggcgagcagaagaaggcaatcgtggacctgctcttcaagaccaaccggaaggtgacggtgaagcagctcaaggaggactacttcaaaaaaatcgagtgcttcgactccgtggagataagcggcgtggaggaccgattcaacgcctccctcggcacctaccacgacctccttaagatcatcaaggacaaggacttcctggacaacgaggagaacgaggacatcctggaggacatcgtgctcaccctgaccctcttcgaggaccgggagatgatcgaggagcgcctcaagacgtacgcccacttgttcgacgacaaggtgatgaagcagctcaagcggcggcgatacaccgggtggggccgcctatcccgcaaacttatcaacggcatccgcgacaagcagtccggcaagacgatcctggatttcctcaagtcggacgggttcgccaaccggaacttcatgcagctcatccacgacgacagcctcacgttcaaggaggacatccagaaggcccaagtgagcggtcaaggggacagcctccacgagcacattgcgaaccttgctgggagccctgcgatcaagaaggggatattgcaaaccgtgaaggtcgtggacgagttggtgaaggtcatggggcgacacaagcccgagaacatcgtgatcgagatggccagggaaaatcagaccacgcagaagggccaaaaaaacagccgcgagcggatgaagcggatcgaggagggcatcaaggagctggggtcgcagatcctcaaggagcacccggtggagaacacgcagctccagaacgagaagctgtacctctattacctacagaacgggcgggatatgtacgtggaccaggagctagacatcaaccgcctgtccgactacgacgtggaccatatcgtcccgcagtcgttcttgaaggacgacagcatcgacaacaaggtgctcacaagatcggataagaatcgaggcaagtccgacaacgtgccctcggaggaggtggtcaagaaaatgaaaaactactggcggcagttgctgaacgccaagctcattacgcagcggaagttcgacaacctgacgaaggctgaacgtggtgggctcagcgagctagacaaggcggggttcatcaagcggcagctcgtcgagacccggcagatcaccaagcacgtggcgcagatcctggactcgcgcatgaacaccaagtacgacgagaacgacaagctcatccgtgaggtgaaggtcatcacccttaagtctaagctggtcagtgacttccgcaaggacttccagttctacaaggtccgggagatcaacaactaccaccacgcgcacgacgcctacctcaacgcggtggtggggacggcgcttattaagaaatatcccaagctggaaagcgagttcgtttacggcgactacaaggtgtacgacgtccgcaagatgatcgcaaagtcggaacaggaaatcggaaaggcgacggccaaatatttcttttactccaacatcatgaatttttttaagacggagatcaccctggcgaacggggagatccgcaagcggcccctcatcgagaccaacggggagacgggcgagatcgtctgggacaagggccgggacttcgccaccgtgcggaaggtgctttctatgcctcaagtcaatatcgtcaaaaagacagaggtgcagaccggcgggttcagcaaggagtctatcctgccgaagcgcaactcggacaagctcatcgcgcgcaagaaagactgggaccccaaaaaatatggcgggttcgactcgccgaccgtcgcctacagcgtcctcgtggtggctaaggtcgagaagggcaagagcaaaaagctaaagtcggtgaaggagctgctgggcatcaccatcatggagcgctcgtctttcgagaagaatccaatcgacttcctagaggcgaaggggtacaaggaggtcaaaaaggatcttatcatcaaactgccgaagtacagtctgttcgagctggagaacgggcggaagcggatgctggctagtgcgggcgagttgcagaagggcaacgagttggcactgccctccaagtacgtgaacttcctgtacctggcctcccactacgagaagctcaaggggagccccgaggacaacgagcagaagcagctattcgtcgagcagcacaagcactacctggacgagatcatcgagcagatcagtgagttctccaagcgggtcatcctcgcggacgccaacctggacaaggtgctgagcgcgtacaacaagcacagggacaagccaatcagggaacaggccgagaacatcatccacctgttcaccctgaccaacctgggtgcaccggctgccttcaagtactttgacacgaccatcgaccggaagcgctacacctccacgaaggaggtgctggacgccacgctgatccaccagagcatcaccgggctctacgagacacggatcgacctgagccagcttggcggggac

SEQ ID NO: 28 - DNA, 4092 bp, Artificial sequence
  Synthetic polynucleotide
gacaaaaagtattccattggactcgctatcggcacgaacagcgtcgggtgggcggtcatcactgacgagtacaaggtgccgagcaagaagtttaaggtgctgggaaacaccgacaggcactcgatcaagaaaaatcttatcggggccctactcttcgactccggagaaaccgccgaggccacccggttgaagcgcacggcccgccgtcgctacaccaggcgcaagaaccggatctgctacctccaggagatattcagcaatgagatggcgaaggtggacgactcgttttttcacaggctagaggagtctttcctcgtggaggaggacaagaaacacgagcgccaccccatcttcggcaacatcgtggatgaggtggcatatcacgagaagtacccaaccatctaccacctccgcaaaaagctcgtggactctaccgacaaggccgacctccgtctgatctacctcgcgctggcccacatgattaagttccgaggacactttctgatcgagggcgacctgaacccagacaacagcgacgtggacaagctgttcatccaacttgtccagacctacaatcagctcttcgaggagaaccctatcaacgcctcgggcgtggacgcgaaggccatcctgtccgcccgcctgagcaagtcgcggcggctggagaacctgatcgcccagctccccggcgaaaaaaagaacggcctcttcggcaacctcatcgcgttgtcgctggggctcaccccgaacttcaagtccaacttcgacctggccgaggacgctaaactccagctctcgaaggatacctacgacgacgacctcgacaacctgctggcccagatcggcgaccagtacgcggaccttttcctggcggccaagaacctgagcgacgcgatcctccttagcgacatactccgtgtgaacaccgagatcacgaaggccccgctctccgcgtccatgattaagcgctacgacgagcaccaccaagaccttaccctgcttaaggcgctggtcaggcagcagttaccggagaagtacaaggagatcttttttgatcaatctaagaacggttacgccgggtacatcgacggcggcgcgtcccaggaggagttctacaagttcatcaagccgatcttggagaaaatggacgggaccgaggagctgctcgtgaagctcaaccgcgaagacctcctccgcaagcagcgcaccttcgacaacgggagcatcccgcaccagatccacctgggagagctgcacgcgatcctgcggagacaagaggacttctaccccttcctcaaggacaaccgggagaagattgaaaaaatacttacttttcgtatcccgtactacgtcgggccccttgcgaggggcaactccagattcgcgtggatgacccgcaagtccgaggagaccatcaccccgtggaacttcgaggaggtggtggacaagggcgcgtcggcccagtcgttcatcgagcgcatgaccaacttcgacaagaaccttccgaacgagaaggtgctcccgaagcacagcctgctctacgaatattttactgtgtacaacgagctgacgaaggtcaagtacgttacggaggggatgaggaagcccgccttcctctccggcgagcagaagaaagccattgtggatctcctgttcaagaccaaccgcaaggtgacggtgaaacagctcaaagaggactacttcaagaagatcgagtgcttcgactccgtagagatcagcggggtcgaggaccgcttcaacgcctcgctgggcacgtaccacgacctgctaaagattatcaaggacaaagacttcctagacaatgaggagaacgaggacattctggaggacatcgtgctgactctgacgctgttcgaagaccgcgagatgatcgaggagcggcttaagacgtacgcccacctgttcgacgacaaggtgatgaagcagttgaaacggcggcgctacaccgggtggggccgcctctcccgcaagctcatcaacggcatccgcgacaagcagtcggggaagacgatcctggacttcctcaagagcgacggcttcgccaaccgaaacttcatgcagctaatccacgacgacagcctgacgttcaaggaggacatccagaaggcccaagtgagcggccagggagactcgctacacgagcatatcgccaacctggctggcagcccggcgattaagaaaggaatcctccaaaccgtcaaagtggtggacgagctggtgaaggtgatgggccgccacaagcccgagaacattgtgatcgagatggcgcgggagaaccagacgacgcagaagggccaaaaaaatagcagggaaaggatgaagcgaatagaggaggggatcaaggagctggggagccagattctcaaagagcacccggtcgagaacacacagctccagaacgagaagctgtacctctactacctccaaaacggccgcgatatgtacgtggaccaggaactagacatcaaccggctgagcgactatgacgtggaccacatcgtgccgcagtccttcctcaaggacgactcgattgacaacaaagtgctcactagatccgacaagaacagaggcaagagcgataacgtcccgtcggaggaggtcgtcaagaaaatgaaaaactactggcggcagctcctaaacgccaagctcatcacgcagcgtaagttcgacaacctgacgaaggcggagcggggcgggctgagcgagctggacaaagcggggttcatcaagcggcagctcgttgagacgcggcagatcacaaagcacgtcgcgcaaatcctcgactcccgcatgaacaccaagtacgacgagaacgacaagctcatccgggaggtgaaggtcattacccttaaatcgaagctcgtcagcgactttcgtaaggacttccagttctacaaggtcagagagatcaacaactaccaccacgcccacgacgcctatctgaacgccgtggtgggcaccgcgcttattaagaagtaccccaagctggagtccgagttcgtgtacggcgactacaaggtttatgacgtcaggaagatgatcgccaagtcggaacaggagatcggaaaagctaccgccaaatatttcttctatagcaacatcatgaacttcttcaaaaccgagatcaccctcgccaacggcgagatccggaagcgcccgctcatcgagaccaacggggagaccggggagatcgtctgggacaaggggcgggacttcgctactgtccgaaaggtgctctccatgccacaagtgaatatcgtcaagaaaacagaggtgcagaccggagggttcagtaaggagtccatcctgcccaagcggaactccgacaagctaattgctcgcaaaaaggattgggatcctaaaaaatatggcggcttcgactcgcccacggtcgcctactctgtgctggtcgtggcgaaggtggagaagggcaagtccaagaagctcaagagcgtcaaggagctgctggggatcacgatcatggagcgtagttcgtttgagaagaatcccatcgacttcctggaggctaagggctacaaggaggtcaaaaaggacctcatcattaagctgccgaagtacagcctcttcgagctggagaacgggcggaagcgtatgctcgcctccgctggggagttacaaaaggggaacgagctggcgctgccgtctaagtacgtcaacttcctgtacctggcctcccactacgagaagctcaaggggtcgccggaggacaacgagcagaagcagctcttcgtagagcagcacaagcactacctggacgagatcatcgagcagatttcagagttctcaaagcgggtcatcctcgccgacgccaacctggacaaggtgctctcggcctacaacaagcaccgggacaagccgatccgcgaacaggccgaaaacatcatccacctgttcacgctcaccaacctcggtgccccggcggccttcaagtactttgacacgaccatcgaccggaagcgctatacctcgacgaaggaggtgctggacgccaccctgatccaccagtccatcaccgggctttacgagacccggatcgacctctcgcagcta

SEQ ID NO: 29 - DNA, 4101 bp, Artificial sequence
  Synthetic polynucleotide
gacaagaagtatagtattggactcgccatcggaaccaactctgtggggtgggctgttattacagatgaatataaggtgccatccaaaaagtttaaagttctgggcaatactgatagacactcaatcaagaagaatctgataggtgcacttctgtttgatagtggagagactgccgaggcaaccagacttaaaaggactgcaagaagaagatataccagaagaaagaataggatttgctatttgcaggaaatcttcagcaacgaaatggccaaggttgatgactcatttttccataggttggaggagagttttcttgtggaggaagataagaagcacgaaagacacccaattttcgggaatatagtggacgaggtggcttatcatgagaagtatcccactatctaccacctgagaaagaaacttgtggactcaaccgataaggctgatcttaggcttatatacttggcccttgcacatatgatcaaattcaggggccattttcttatcgaaggcgatcttaatcccgataactcagatgtggacaagctgtttatacaacttgtgcaaacctacaatcaactcttcgaggagaatcccattaacgcctccggcgtggatgcaaaagccatactgtcagccagactgagcaaaagtaggagactggagaatcttatagcccaactgcccggtgaaaagaagaatgggctcttcggaaatctgatcgctctttcattggggttgacacccaactttaagagtaactttgacttggcagaagatgcaaagttgcagctcagtaaagacacatatgacgatgaccttgacaatctcttggcacaaataggggatcaatacgctgaccttttcctcgctgccaagaacctcagcgacgctatactgttgtccgacattcttagggttaataccgaaattacaaaggcccctcttagtgcaagtatgatcaaaaggtatgatgagcatcaccaagaccttacactgctgaaggctctggttagacagcaactccctgaaaagtataaggaaatattcttcgaccaaagtaagaacgggtacgccggttatattgatgggggcgcaagtcaagaagaattttacaaattcatcaagccaattcttgaaaagatggacgggactgaggaattgctggtgaaactgaatagagaggaccttcttagaaaacagaggacatttgacaatgggtccatcccacaccagattcatctgggggaactccacgcaatattgaggagacaagaagacttttacccattccttaaggataatagagagaaaatcgaaaaaatcctgactttcaggattccttactatgttgggccactggccagggggaactcaagattcgcttggatgacaaggaagtcagaagaaaccataaccccttggaattttgaagaggtggttgataagggggcatcagcccagtctttcatagagaggatgaccaactttgataaaaatcttccaaatgagaaggttttgccaaaacatagtcttttgtacgagtactttactgtttataacgaattgaccaaggtgaagtatgtgaccgagggaatgaggaagccagcatttttgtccggggagcaaaagaaagcaatcgttgatcttctcttcaagaccaacagaaaagtgaccgtgaaacaactgaaggaagactacttcaaaaagatagaatgtttcgattcagtggaaattagcggtgttgaagacaggttcaatgcttcattgggtacttaccacgacctgttgaagataatcaaagacaaggactttctcgataatgaggagaacgaagacatcttggaagacattgtgcttacactcactttgtttgaggacagggaaatgattgaggaaagactcaaaacttacgctcatttgtttgatgataaggttatgaaacaactaaaaagaagaaggtacaccggctggggaagattgagtaggaaactgatcaacggtattagagataaacaatccggaaagactatcctcgatttccttaagagtgatggctttgcaaataggaattttatgcagctgattcatgacgactcacttaccttcaaagaagacatccaaaaagctcaggtgtctgggcaaggcgacagtctgcatgaacatatagctaacttggctgggagtcccgccatcaagaaggggatacttcaaacagttaaagttgtggacgaattggtgaaggtaatgggaaggcacaagcctgaaaatatagtgatagaaatggcaagggaaaatcaaacaacccagaagggacagaagaacagtagggaaaggatgaaaaggatagaagaggggatcaaagagcttggtagccagatcctcaaggaacatccagtggagaatacccaacttcaaaacgagaaactctatttgtactacttgcagaacggaagagatatgtatgtggaccaagagcttgatattaacaggctgagcgattatgacgttgaccacatagtgccccaatcattcctcaaggatgactctattgataataaggtgctgacaaggagtgacaagaatagagggaaatccgacaacgttccatccgaggaagttgtgaagaagatgaagaactactggaggcagttgctgaacgctaagctcattacccagaggaaattcgataacctgaccaaagcagagagaggcgggctgagcgaactcgataaagcaggtttcatcaagagacaactcgtggagactaggcaaattactaagcacgtggctcaaatactcgacagcaggatgaacacaaagtacgacgagaacgacaagctcattagagaggttaaggttattactctgaaaagtaaattggttagcgatttcagaaaggatttccaattctataaggttagagagatcaacaattatcatcatgcacatgatgcctatctgaatgctgtggttggtacagcccttatcaagaagtaccctaagctagagagcgagtttgtgtacggagattataaggtgtatgatgtgaggaaaatgatcgctaaaagtgagcaagagattggaaaggctaccgccaaatacttcttttattccaatattatgaatttcttcaagacagaaatcaccctggctaacggcgagataaggaagaggccgcttatcgaaactaatggggagacaggcgaaatagtgtgggacaaagggagggatttcgcaactgtgaggaaggttttgagcatgcctcaggtgaatatcgttaagaaaaccgaagttcaaactggagggttctctaaggaaagcattctccccaagaggaactccgacaagctgattgctagaaagaaagactgggaccccaagaagtatggcggattcgactcacccactgtggcatatagcgttctcgtggtggcaaaggttgaaaagggtaaatccaaaaaactcaaatccgtgaaggaactccttggcataactattatggaaaggagtagctttgaaaagaatcccatcgactttctcgaagctaagggctataaggaagttaagaaggaccttataatcaaacttccaaaatactccctttttgagttggaaaacggcagaaagagaatgttggccagtgccggggagcttcaaaagggcaacgaactggctctgcctagcaaatatgtgaactttttgtatctggcatcacactacgagaaacttaaaggctctcctgaggacaacgagcaaaaacagctctttgttgaacagcataagcactacctcgacgagattattgagcagatcagcgagttctcaaagagagttattctggctgacgctaatcttgacaaggttttgtccgcttacaacaaacacagggataagccaatcagggagcaggcagaaaacataatccatctctttaccctgacaaacctcggtgcccccgctgctttcaagtattttgatactaccattgacaggaagagatatacttccactaaggaagtgctcgacgcaaccctcatacaccaaagtatcacaggcctctatgaaactaggatagatttgtctcaacttgggggcgat

SEQ ID NO: 30 - DNA, 4101 bp, Artificial sequence
  Synthetic polynucleotide
gacaaaaagtattccatcgggcttgctatcggaaccaactctgtggggtgggcagttattaccgacgaatacaaggtgcccagcaagaagtttaaggttctggggaacacagatagacatagcataaagaaaaacctgataggcgcactgttgttcgactccggggaaacagccgaagctaccaggctgaagagaactgcaagaagaaggtacaccagaagaaaaaacagaatatgttatctccaagagattttctctaacgagatggccaaggtggacgactcattctttcacagactggaagaatctttccttgtggaagaagataagaaacacgagaggcaccctatttttggcaatatcgtggatgaggtggcttaccacgaaaaataccctacaatataccacctcaggaaaaaattggttgatagtacagacaaggccgacctcaggctcatctatttggccctggcccatatgattaaattcagggggcactttctcatcgagggagatttgaaccccgacaacagtgatgttgataagctctttattcagctcgtgcagacttacaatcagttgtttgaggaaaaccccattaatgcttccggggtggacgccaaggcaatcctttctgcaagactctcaaagtcaaggagactcgaaaatctgatagcacagcttccaggagagaagaagaacgggctctttggaaacctgatcgctctgtcactcggactcacacccaatttcaaaagcaattttgatttggcagaggacgctaagctgcaactcagtaaggatacctacgacgatgacttggataatctgctcgcacaaattggggaccagtatgcagacctgtttctcgcagctaagaacttgagtgacgccatattgctcagtgacatcctcagggttaataccgagattacaaaagctccactctctgcaagcatgatcaagaggtatgacgagcaccatcaagacctgacactccttaaggcgttggttaggcagcaacttcctgaaaagtataaggaaatcttcttcgatcaaagcaaaaacggctacgccggctatatagacgggggagcatcccaagaagaattttataagttcataaaacctatattggagaagatggacgggacagaggaattgctcgtgaaactgaacagggaggatctcctcaggaagcaaaggaccttcgacaatggctccatcccacatcagattcacctcggcgaactgcacgcaatactgagaagacaagaggacttttatcctttcctgaaggacaacagggagaaaatcgagaaaatcttgacattcagaatcccatactacgttgggcctctggccagaggtaacagtaggttcgcctggatgactaggaaatcagaggagactattacaccctggaactttgaagaagttgttgataagggagcttcagcacaatcattcatcgaaagaatgacaaactttgacaaaaatctgcctaatgagaaagtgctcccaaaacattccctgctgtatgagtattttaccgtttataacgagcttaccaaggtgaaatacgttactgaaggtatgagaaagccagcttttctttcaggggagcaaaagaaggctatcgtggatcttctctttaagaccaacagaaaggttaccgtgaagcagcttaaggaagactactttaaaaagatcgagtgttttgactcagtggaaataagcggtgttgaagatagattcaacgcatccttgggaacttatcatgatcttcttaagataatcaaggataaagactttctcgacaacgaggaaaacgaagatatactggaggacatagttctgacacttactttgttcgaggatagggagatgatcgaggaaagactgaaaacatatgctcaccttttcgacgacaaagttatgaaacaactcaagagaaggagatatacagggtgggggagattgagcaggaaactgattaatggtatcagagacaaacagtcaggaaaaacaatactcgactttttgaaatcagacgggttcgcaaataggaatttcatgcagcttatacacgacgattcacttacttttaaagaggacattcaaaaggctcaagttagtggacaaggtgactccctccacgaacacatcgcaaatctcgctggcagccctgcaattaagaagggtatactccagacagttaaggttgttgacgagctggttaaagtgatgggaagacacaaacccgagaacatagtgatagagatggccagggaaaaccaaaccactcaaaaagggcagaaaaattccagagagaggatgaaaaggattgaagaaggtatcaaggagctgggtagccaaattctgaaagaacatcctgtggaaaacactcaactccagaatgagaaactctatctgtactatctgcaaaatgggagagatatgtatgtggaccaggaactggacataaacaggctctcagattacgatgtggatcatatcgtgccacagtcctttcttaaggatgatagcatcgacaataaggtgcttaccaggtccgacaagaacaggggaaagtcagataacgtgccttctgaagaagttgttaaaaagatgaagaactactggagacagctgcttaacgctaagctcataacacagaggaagtttgacaacttgaccaaggccgagagaggcggactctcagaattggataaggcagggttcataaaaaggcagctggtggaaacaaggcagataactaaacatgtggctcagatcctcgatagtaggatgaatacaaaatacgatgagaacgacaagctcataagggaggttaaagtgataactctgaaatccaaactggttagcgattttaggaaggatttccagttttacaaagttagggagatcaacaattatcatcacgcccacgatgcctacttgaacgcagttgtgggtactgcacttatcaaaaagtaccctaagctggaatccgagtttgtttatggagactataaggtgtacgacgttagaaaaatgattgcaaagtcagagcaggagatagggaaagccactgcaaaatatttcttttatagcaatatcatgaatttctttaagacagaaatcacactggccaatggggaaataaggaagaggcccctgatcgaaactaatggcgagacaggggagattgtgtgggataaaggtagggactttgcaacagtgaggaaagtgctgagcatgccccaagttaatatcgttaaaaagaccgaggttcaaacagggggctttagtaaggaaagcattttgcccaagaggaatagtgacaaattgattgctaggaaaaaagattgggaccccaaaaagtatggcggatttgatagccccactgttgcttactccgtgctcgtggttgcaaaggtggagaagggaaagagcaagaaactgaagtcagttaaggaactccttggtatcactatcatggaaagaagctcctttgagaagaaccctattgacttcctggaggctaaagggtacaaagaggttaagaaagaccttatcattaaattgcccaaatatagtcttttcgagcttgaaaacggaagaaagaggatgcttgcatccgctggcgaattgcaaaagggcaatgagcttgctctcccttccaagtatgtgaacttcctttatcttgcctcacactatgaaaaactcaaaggttcacccgaagacaacgaacaaaagcaactatttgtggaacaacacaagcactacctggacgaaatcattgagcaaatttctgagttttcaaaaagggtaatcttggctgacgcaaatctcgacaaagttttgtcagcttacaacaaacatagagataagccaattagagagcaagctgagaatatcatccatctgtttaccctgactaaccttggagcgcctgctgcttttaaatatttcgacaccacaatcgacaggaagaggtacactagcactaaggaagttctcgacgccaccctcatccaccagagtattacaggcctgtacgagacaagaattgatctttctcaacttggtggtgac

SEQ ID NO: 31 - DNA, 4101 bp, Artificial sequence
  Synthetic polynucleotide
gataagaagtactcaatcggtctggcaatcggaaccaactctgtgggttgggcagtgattacagatgagtataaggtgccaagcaaaaaattcaaggtgctgggtaataccgacagacacagcattaagaagaatttgattggagcactcctctttgactcaggggaaacagcagaggcaacaaggctgaagaggacagcaaggcggaggtacacaaggcggaaaaacaggatatgctacctccaggaaatctttagcaacgagatggctaaagtggatgatagctttttccatagactcgaagaatcctttcttgttgaagaggacaaaaagcatgaaaggcatcccatcttcggcaatatagttgatgaggttgcataccatgagaagtaccccacaatctaccacctcagaaagaaacttgtggactccacagataaagcagacctgaggctcatatacctcgcactcgcacacatgatcaagttcagagggcactttctcatcgaaggtgacctgaatccagataattcagatgtggataaactgtttatacagctggtgcaaacatacaaccaacttttcgaggaaaacccaatcaatgcctccggtgttgatgcaaaggccatcctgtcagcaagactcagcaaaagcaggcggctcgaaaacctcatcgcccagcttcccggtgaaaagaagaacgggctctttggtaatctcatcgcattgagccttggtcttactccaaacttcaagagcaattttgatctggcagaggatgctaaactgcaactctcaaaggacacatatgacgatgaccttgacaatctgttggcccagatcggggaccaatatgcagacctcttcctggccgcaaagaatctgtcagatgcaatcctcttgtccgacatactgagagttaacactgagatcacaaaggcacctctgtccgcctccatgattaagagatacgatgagcatcaccaggatctgactttgctcaaagccctcgttagacagcagttgccagaaaagtacaaagaaatattctttgatcaatcaaaaaacggatatgcagggtacatcgacggtggggcaagccaggaagagttctacaaattcatcaaacctatcctggaaaagatggatgggacagaagagctgctggttaagctgaatagggaagacctcctcagaaagcagaggacatttgataacgggagcatccctcatcaaatccacctcggtgaactccatgctatcctgagaaggcaggaagacttttatccatttttgaaggacaatagggagaaaatcgaaaaaatcctgacattcagaatcccatactacgttggtcctctggcaagaggtaacagtaggttcgcatggatgacaaggaaaagcgaggagacaatcacaccctggaattttgaggaagttgttgacaagggtgccagcgcacaatcctttatcgaaagaatgacaaatttcgacaagaatctgcctaacgaaaaggttctcccaaagcattcactcctgtacgaatattttacagtttataacgaactgactaaagttaaatacgttaccgagggtatgaggaagccagcattcctttccggggaacagaagaaagctattgtggacctcctgttcaagacaaatagaaaagtgacagttaagcaactcaaagaggattacttcaaaaagatcgaatgttttgactctgtggagatcagcggggtggaggatagattcaacgccagcctgggtacatatcatgatctcctgaaaatcattaaagacaaggacttccttgacaacgaggagaacgaggacattctggaagacattgttctgaccctcacactctttgaggatagggagatgattgaggaaagactgaagacctacgcccacctctttgacgataaagtgatgaaacagctcaagagaagaaggtatacaggttgggggagactgagcaggaagttgatcaatgggattagggacaaacagtccgggaaaacaatcctcgattttctgaagtcagacggtttcgcaaacagaaattttatgcagctcattcacgatgacagcttgacattcaaggaagacatccaaaaggctcaagtgagcggccaaggggatagcctccacgagcatattgcaaatctggcaggttcaccagccatcaaaaagggcatacttcagacagttaaggttgtggacgaattggttaaagttatgggcaggcataagccagagaatatcgttatcgaaatggcaagggagaaccaaacaactcaaaaagggcagaaaaatagcagagagaggatgaaaagaatcgaggaagggatcaaggaacttgggtcccaaatcctcaaggagcacccagttgaaaatactcaactgcaaaacgagaagctctatctctactatctccaaaacgggagggatatgtatgttgaccaggagctggatattaacagactgtcagattatgatgttgatcatatcgtgccccagtcattcctgaaggacgattccatcgacaacaaagttctcacaaggtccgataaaaacaggggcaagtccgataacgttccaagcgaagaagtggtgaaaaagatgaaaaactattggagacaacttctgaatgcaaagttgattactcagagaaagtttgacaacctcacaaaagcagaaagaggcgggcttagcgaactcgataaggcagggtttatcaaaagacagctggttgagacaaggcagatcacaaaacatgtggcacagatccttgactcaaggatgaataccaagtatgatgagaatgataagttgatcagggaggttaaagttatcacactcaaatccaaactggtgtcagacttcaggaaagactttcaattttataaggtgagggagatcaataactaccaccatgcacatgacgcctacctgaacgcagtggtgggtacagcattgattaaaaaataccctaagctggagtctgagtttgtgtacggggactacaaggtgtacgacgtgaggaaaatgatagccaagtccgagcaggagatcgggaaagcaacagctaagtatttcttttacagtaatatcatgaatttctttaaaactgagattactctggcaaacggggagatcaggaaaagacccctcatcgagactaatggtgaaacaggtgagatcgtttgggacaaggggagggattttgctactgttagaaaagttctgagtatgccacaagtgaatattgtgaaaaagacagaagttcagacaggtgggttctccaaagaatccatcctgcccaagagaaattcagacaagctcatcgcaagaaagaaggactgggaccctaagaagtacggaggatttgacagccccaccgtggcctattccgtgcttgttgtggcaaaggtggagaaagggaagagcaaaaaactgaaatccgtgaaagaactgctgggaattaccatcatggaaagaagctcctttgagaagaacccaatcgacttcctggaagcaaaaggatataaggaagtgaaaaaggacctcattatcaagctcccaaaatactcacttttcgagttggagaacggtagaaagaggatgctggcaagcgcaggggaacttcagaaaggcaatgagctggcattgccatcaaagtatgtgaacttcctctacttggccagccattacgagaaacttaaaggtagcccagaagataacgagcaaaaacagctctttgtggaacagcataagcattatctggatgagatcatagaacaaatctcagagttttccaagagagttatcctcgcagatgcaaacctggataaggttctctcagcctataataagcatagagacaagccaattagagagcaagcagagaacattatccacttgttcactcttacaaacctgggggcaccagccgccttcaaatatttcgatacaacaatagacagaaagaggtataccagcaccaaagaagttctcgacgccacactgatccatcaatcaatcacaggcctttacgaaactaggatcgacttgtcacaactgggtggggat

SEQ ID NO: 32 - DNA, 3307 bp, Artificial sequence
  Synthetic polynucleotide
gagcaaggacacctacgacgacgacttggacaacctattggcccagataggtgaccagtatgcagacctcttccttgcggccaagaacttgagtgacgctatactgctcagtgacatcctgagggtgaacactgagatcactaaggcccctctctctgcctcaatgattaagcgttacgacgagcatcaccaggatctcaccctgcttaaggcccttgttcggcagcagctccctgagaagtacaaggagatattttttgaccagtctaagaacggctacgccggttacattgacggtggggcaagccaggaggagttctacaagttcatcaagccgatccttgagaagatggacggcaccgaggagctacttgtcaagttgaaccgggaagacctgctccggaaacagcgtacattcgacaacggcagcatccctcaccagatccacctgggcgaactacacgccatcctccgacgtcaggaggacttctatccattcttgaaagataacagggaaaaaatcgaaaaaatacttacgtttcgaataccttactacgtggggccccttgctcggggaaactccagattcgcatggatgaccaggaagtcagaggagaccatcacaccctggaactttgaggaggtggttgacaaaggtgcttctgcccagtccttcattgagcggatgactaacttcgacaagaacctgcccaacgagaaggtgctgccaaagcacagcctgctctacgaatactttactgtgtacaatgagctgacgaaggtgaagtacgtgacagaggggatgcggaagcccgctttcctgagcggcgagcaaaaaaaagcaatcgtggacctactgttcaagaccaaccgaaaggtgacagtgaagcagctcaaggaggactacttcaaaaaaatcgagtgcttcgactctgttgagataagcggcgtggaggaccgattcaacgcctcattgggaacctatcacgacctgctcaagatcattaaggacaaggacttcctggataatgaggagaatgaggacatcctggaggatattgtgctgacccttactctattcgaggacagggagatgatcgaggagcgactcaagacctacgctcacctgttcgacgacaaggttatgaagcaattgaagcgtaggcgatacacggggtggggaagactctcccgaaaactgataaacggcatcagggacaagcagtcagggaagacgatcttggacttcctgaaatccgacgggttcgccaaccgcaacttcatgcagctcattcacgacgactcactaacgttcaaagaggacattcagaaggctcaagtcagtggacaaggcgactccctgcacgagcacattgcaaaccttgcgggctccccggcgattaaaaagggcattctccaaacggttaaggtggtggacgagctggtgaaggtgatgggccgacacaagcctgagaacatcgtgatcgagatggccagggagaaccagactacccagaagggtcagaagaactctcgggaacgtatgaagcgtattgaggaggggattaaggagttgggctctcaaatcctcaaggagcaccctgtggagaacactcagctccaaaacgagaagctgtacctgtactacctgcaaaacgggcgcgatatgtacgtggatcaggagttggacatcaacaggcttagcgattacgacgtggaccacatcgtgccacagtcattcttaaaggacgacagcatcgacaacaaggttctgacgaggagcgacaagaatcgagggaaaagtgacaatgttccatccgaggaggtggtcaagaaaatgaagaactattggcgtcagcttctgaacgccaagctcatcacccagcggaaattcgacaacctgactaaggctgagcgaggcggactctccgagcttgacaaggctggcttcatcaagcggcagttggtcgaaacccgacagataacgaagcacgttgcccagatacttgactcccgtatgaacaccaagtacgacgagaacgacaagctcatcagggaggtgaaggtcattacccttaagtccaaactcgtcagcgactttcgtaaggacttccagttctacaaggtgcgcgagatcaataactaccaccacgcacacgacgcctacctgaacgcagtggttggaaccgcgttgattaaaaagtaccccaagttggagtcggagttcgtttacggggactacaaggtgtacgacgttcggaagatgatcgccaagtctgaacaggagatcgggaaagcaaccgccaagtatttcttctatagcaacatcatgaacttctttaaaaccgagatcacacttgccaatggcgagatccgtaagaggccgctgatcgagacaaatggggagactggcgagatcgtgtgggacaagggccgcgacttcgcaaccgttcggaaagtcttgtccatgcctcaagtcaacatcgtcaagaagactgaggtgcaaacaggcgggttctcgaaggagtccatactgcccaagaggaactcagacaagctcatagcacgcaaaaaagactgggatccaaagaaatacggcgggttcgactcgccgacagtcgcatactccgtgttagtggtggctaaagtggaaaaggggaagtccaagaagctcaagtccgtcaaggagttgctcgggatcaccattatggaacggtcctcattcgagaagaatcccattgacttcctagaggcgaagggctacaaagaggtcaaaaaggacctaattattaagctccccaagtattcactcttcgaacttgaaaatggtcgtaagcggatgttggcaagcgctggagagcttcagaaggggaacgagcttgcactgccttccaagtacgtgaacttcctgtacctcgcctctcattacgagaagttgaagggctcaccggaggacaacgagcagaagcagttgttcgtggagcagcacaagcactacctcgacgagatcattgagcagataagtgagttcagcaaacgggtgatccttgccgacgctaacctggacaaggtgctgagcgcctacaacaagcacagagacaagccgatccgagagcaagcggagaacatcatacacctgttcaccctcacgaacctcggggctcccgcagccttcaaatattttgacacgaccatcgaccgtaaacgctacactagcacgaaggaggtgctggacgctacccttatccaccagtccatcaccggcctgtacgagacgagaatcgacttgtcgcagctcggtggtgac

SEQ ID NO: 33 - DNA, 4101 bp, Artificial sequence
  Synthetic polynucleotide
gacaaaaaatactcaattggtctggcaattgggaccaacagtgtcggatgggccgtgattaccgacgagtacaaggtgccgtccaaaaaattcaaggtgcttgggaacaccgaccgccactcgatcaagaaaaacctaatcggtgcgttgcttttcgacagtggggagaccgccgaggcaacacgcttaaaacgcacagctaggaggagatatacacggcgcaagaaccgaatatgctacttacaggagatattctccaatgagatggcgaaggtggacgactctttcttccatcggcttgaggaatccttcctggtcgaggaggacaagaagcacgagcgacacccgatattcgggaacatcgttgatgaggtggcgtaccacgagaagtacccaacgatataccacttacgcaagaagctcgtggactctacggacaaggccgacttgcgccttatctacttggcactggcccacatgattaagttccgaggccacttccttatcgagggtgacctgaaccccgataactccgacgtggacaagctcttcatccaactcgtccagacatacaaccagctattcgaggagaatcctatcaacgcctctggggtggacgctaaagctatcctctcagcccgcctgtcaaagtcgaggaggttggagaacctaatcgcccagcttccaggcgagaagaaaaatgggctgttcggaaaccttatcgcactctcactgggcctaaccccgaacttcaagtccaacttcgacctggcagaggacgcgaaattgcagttgtcgaaagacacctatgacgatgacctggacaacctgttggcccagataggggaccagtacgccgacctgttcctagcggccaagaacctgtccgacgccatcttgctgtcggatatactgcgggtgaacaccgagatcactaaagcacctctctccgccagcatgattaagcgttacgacgagcaccaccaagatttgaccctgctaaaggcacttgtacggcagcagcttcccgagaagtacaaggagatctttttcgaccaaagcaagaacggctacgccgggtacatcgacggaggtgccagccaggaggagttctacaagttcattaagcccatcctggagaagatggacgggactgaggaactacttgtgaagctgaaccgggaagacttactacggaagcagcgtaccttcgacaacggttctatcccacatcagatccatcttggggagttgcacgcgatcctgcgacgccaggaggacttttaccccttcctgaaagacaaccgcgagaaaatcgagaagatactgaccttcagaataccttactacgtcggaccccttgcgcgaggcaactcaagattcgcgtggatgaccaggaaatcagaggagaccatcacaccctggaatttcgaggaggtggttgacaagggtgcctccgcccagtcctttatcgaacgaatgaccaacttcgacaagaacttgcccaacgagaaggtgctccccaaacacagcctcctctacgaatatttcacagtgtacaacgagcttactaaagttaagtatgttactgagggcatgaggaaacccgccttcctgtcaggcgagcagaagaaagctattgtggacctccttttcaagaccaaccggaaggtgacagtgaagcagctcaaggaggactacttcaagaagatagagtgcttcgacagcgtggagatcagcggggtggaggacagattcaatgcctctctcggaacataccacgacttgcttaagatcatcaaggacaaggacttcctcgacaacgaggaaaacgaggatattctggaggatattgttctgactcttaccctgttcgaggaccgggagatgatcgaggagcgtctcaagacctacgcccacctgttcgacgacaaagttatgaagcagctcaagcgtcggagatataccggatggggccgtctgtctcggaagctcatcaacgggatcagggacaagcagtcagggaagacgatcttagacttccttaagtctgacggcttcgccaacaggaacttcatgcagttgatccacgacgacagccttaccttcaaggaggacatccagaaggcccaagtgagtggccagggtgacagcctccacgagcatattgctaatcttgcgggttccccagcgattaaaaagggcatacttcaaaccgttaaggtggtggacgagcttgtcaaggtgatggggcgacacaagcccgagaacatcgtgatcgagatggccagggagaaccagaccacccagaaggggcagaagaatagccgagaacgcatgaagcgcatcgaggaggggattaaggagctagggagccagatcctcaaggaacatcccgtcgagaacacccagctccagaacgagaagctatacctctactacttgcaaaacgggagggatatgtacgtggatcaggagttggacattaaccgcctaagcgactacgacgtagatcacatcgtgcctcagtcattcctcaaagacgacagcattgacaacaaagtcttgacccgatccgacaagaaccgaggaaaatccgacaatgtgccctcagaggaggtcgtcaagaaaatgaagaactattggaggcagctacttaacgccaaactcataacccagcggaagttcgacaacctgacaaaggctgagcggggtgggctcagcgagcttgacaaggctggcttcatcaagcggcagttggtggagacaagacagataacgaagcacgtggctcagatcctggactctcgcatgaacacgaagtacgacgagaacgacaaattgatccgcgaggtcaaggttattacgctcaagagcaaacttgtcagcgatttccgcaaggacttccagttctacaaggtgagggagattaacaactaccaccatgcacatgatgcctacttgaacgcagtggtggggaccgcgcttattaaaaagtaccctaagttggagtcagagttcgtttatggggactacaaggtgtacgacgtccggaagatgattgcaaagtctgaacaggaaatcgggaaggccaccgccaaatatttcttctacagtaacattatgaatttttttaagactgaaattactctcgcaaacggcgagatcaggaagcgtcccctcatcgagacaaacggggagaccggggagatagtctgggacaaggggcgggacttcgctacggtgaggaaggtgctctcgatgccacaagtgaacatcgtcaaaaagacagaggtgcagaccggtggcttctcaaaggagtcaatcctgccaaaacgtaacagcgacaagctcatcgcccgcaagaaagactgggaccctaagaagtatggtgggttcgactcaccgacggtcgcatactccgttctggtcgtggcaaaggtggaaaagggcaagtccaaaaaactgaaatccgtgaaggagttgcttggcattaccatcatggaacgcagcagcttcgagaagaaccccattgacttcctggaggctaaagggtacaaggaggtcaagaaagatttaattattaagctacctaagtacagcttgttcgagctggagaacggccgaaaacgaatgctcgcatccgccggggaacttcaaaagggcaacgagcttgcgctgccctccaagtacgtgaacttcctgtacttggcatcccactacgagaaactcaagggtagcccagaggacaacgagcagaagcagctattcgtggagcagcacaagcactacctcgacgagataatcgagcagatcagtgagttcagtaagcgggtgatactcgcggacgccaacttggacaaggtgcttagtgcctacaacaagcaccgtgacaagcccatccgagaacaggctgagaacatcatccaccttttcactctgacaaacctcggtgctcccgccgccttcaaatacttcgacactaccatcgacaggaagcgctacacatctacgaaggaagttcttgacgctacgcttattcatcagtctatcacagggctgtacgagacaaggatcgaccttagccaactcggcggggat

SEQ ID NO: 34 - DNA, 4101 bp, Artificial sequence
  Synthetic polynucleotide
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 35 - DNA, 4101 bp, Artificial sequence
  Synthetic polynucleotide
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctggccgacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctgccctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaaggcccctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 36 - DNA, 4101 bp, Artificial sequence
  Synthetic polynucleotide
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 37 - DNA, 4101 bp, Artificial sequence
  Synthetic polynucleotide
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 38 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 41 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 42 - DNA, 621 bp, Petromyzon marinus
acagatgcagagtatgtgagaattcacgaaaagctggacatctataccttcaagaagcagttctttaacaataagaagtctgtgagccataggtgctacgtgctgttcgagctgaagagaaggggtgaaagaagggcatgtttttgggggtatgctgtgaacaagccccagtctggaactgagagaggcattcacgccgaaattttcagcatcagaaaggtggaggaatacctgagggataaccctggacagtttacaattaattggtattctagctggtctccatgcgctgactgtgccgagaagatcctggaatggtacaaccaggagctgagaggaaatggccataccctgaagatttgggcctgcaagctgtactatgaaaagaacgcaagaaatcagatcggactgtggaacctgagggataatggtgtggggctgaacgtgatggtgtccgagcactatcagtgctgtagaaagattttcattcagtcctcacataatcagctgaacgagaatagatggctggaaaagactctgaagagggctgagaagagaaggtccgaactgtcaattatgatccaggtgaagatcctgcacaccactaagtcacctgccgtg

SEQ ID NO: 43 - protein, 159 aa, Artificial sequence
  Synthetic polypeptide
ERNYDPRELRKETYLLYEIKWGKSGKLWRHWCQNNRTQHAEVYFLENIFNARRFNPSTHCSITWYLSWSPCAECSQKIVDFLKEHPNVLEIYVARLYYHEDERNRQGLRDLVNSGVTIRIMDLPDYNYCWKTFVSDQGGDEDYWPGHFAPWIKQYSLKL

SEQ ID NO: 44 - protein, 229 aa, Rattus norvegicus [sequence omitted]

SEQ ID NO: 45 - protein, 198 aa, Homo sapiens [sequence omitted]

SEQ ID NO: 46 - protein, 197 aa, Artificial sequence
  Synthetic polypeptide
MDSLLMNRREFLYQFKNVRWAKGRRETYLCYVVKRRDSATSFSLDFGYLRNKNGCHVELLFLRYISDWDLDPGRCYRVTWFISWSPCYDCARHVADFLRGNPNLSLRIFTARLYFCEDRKAEPEGLRRLHRAGVQIAIMTFKDYFYCWNTFVENHGRTFKAWEGLHENSVRLSRQLRRILLPLYEVDDLRDAFRTCT

SEQ ID NO: 47 - protein, 207 aa, Artificial sequence
  Synthetic polypeptide
TDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 48 - protein, 228 aa, Artificial sequence
  Synthetic polypeptide
SSKTGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPNVTLFIYIARLYHLANPRNRQGLRDLISSGVTIQIMTEQESGYCWHNFVNYSPSNESHWPRYPHLWVRLYVLELYCIILGLPPCLNILRRKQSQLTSFTIALQSCHYQRLPPHILWATGLK

SEQ ID NO: 49 - protein, 162 aa, Artificial sequence
  Synthetic polypeptide
SFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 50 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 51 - protein, 166 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 52 - protein, 166 aa, Artificial sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 53 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 54 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 55 - protein, 1763 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 56 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 57 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 58 - protein, 364 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 59 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 60 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 61 - protein, 83 aa, Bacillus phage AR9
TNLSDIIEKETGKQLVIQESILMLPEEVEEVIGNKPESDILVHTAYDESTDENVMLLTSDAPEYKPWALVIQDSNGENKIKML

SEQ ID NO: 62 - RNA, 19 nt, Artificial sequence
  Synthetic oligonucleotide
  misc_feature (1)..(19): n is a, c, g, or u
nnnnnnnnnnnnnnnnnnn

SEQ ID NO: 63 - DNA, 22 bp, Artificial sequence
  Synthetic oligonucleotide
  misc_feature (4)..(22): n is a, c, g, or t
aaannnnnnnnnnnnnnnnnnn

SEQ ID NO: 64 - DNA, 22 bp, Artificial sequence
  Synthetic oligonucleotide
  misc_feature (4)..(22): n is a, c, g, or t
tttnnnnnnnnnnnnnnnnnnn

SEQ ID NO: 65 - protein, 24 aa, Artificial sequence
  Synthetic peptide
EELLSKNYHLENEVARLKKGSGSG

SEQ ID NO: 66 - protein, 241 aa, Artificial sequence
  Synthetic polypeptide
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 67 - protein, 277 aa, Artificial sequence
  Synthetic polypeptide
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 68 - DNA, 66 bp, Saccharomyces bayanus
ttcttgtcgtacttatagatcgctacgttatttcaattttgaaaatctgagtcctgggagtgcgga

SEQ ID NO: 69 - protein, 605 aa, Homo sapiens
MSGWESYYKTEGDEEAEEEQEENLEASGDYKYSGRDSLIFLVDASKAMFESQSEDELTPFDMSIQCIQSVYISKIISSDRDLLAWFYGTEKDKNSVNFKIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPLKEACRAYGLKSGLKKQELLEALTKHFQD

SEQ ID NO: 70 - protein, 482 aa, Artificial sequence
  Synthetic polypeptide
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 71 - DNA, 10 bp, Methanobacterium thermoautotrophicum
aatttttgga

SEQ ID NO: 72 - protein, 83 aa, Methanobacterium thermoautotrophicum
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 73 - DNA, 25 bp, Escherichia virus MS2
gcgcacatgaggatcacccatgtgc

SEQ ID NO: 74 - protein, 116 aa, Escherichia virus MS2
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 75 - DNA, 26 bp, Bacteriophage PP7
ataaggagtttatatggaaaccctta

SEQ ID NO: 76 - protein, 127 aa, Bacteriophage PP7
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 77 - DNA, 19 bp, Shigella flexneri
ctgaatgcctgcgagcatc

SEQ ID NO: 78 - protein, 62 aa, Shigella phage SfMu
MKSIRCKNCNKLLFKADSFDHIEIRCPRCKRHIIMLNACEHPTEKHCGKREKITHSDETVRY

SEQ ID NO: 79 - protein, 325 aa, Schizosaccharomyces pombe
MNDIETRDTGTKNDNSSEFNLSVKSHKRKRSFDDENLELEESREETSGGILKKAKTQSFSESLERFRFAHAGSNNEYRKTDVVKNSDTDNGLLKSAVETITLENGLRNRRVNVTKKSTLKASVKKSTLKKKNEVDPALLQGVPDYICENPYAIIVGLNPGITSSLKGHAFASPSNRFWKMLNKSKLLEGNAEFTYLNDKDLPAHGLGITNLCARPSSSGADLRKEEMQDGARILYEKVKRYRPQVGLFISGKGIWEEMYKMLTGKKLPKTFVFGWQPEKFGDANVFVGISSSGRAAGYSDEKKQNLWNLFAEEVNRHREIVKHAV

SEQ ID NO: 80 - protein, 318 aa, Rattus norvegicus
  misc_feature (312)..(312): Xaa can be any naturally occurring amino acid
MSKEPVSVVLPDAEHPAFPGRTRRPGNARAGSQVTGSREVGQMPAPLSRKIGQKKQQLAQSEQQQTPKEKLSSTPGLLRSIYFSSPEDRPARLGPEYFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQLRNSLRKSTVGRSLKDRELCNGPSKLCQALARSKSFDQRDLAQDEAVWLEHGPLESSSPAVVAAAAGIGHAGEWTQKPLRFYVQGSPWVSVVDRVAEQMYQPQQTACSDXALIVQK

SEQ ID NO: 81 - protein, 158 aa, Methanosarcina acetivorans
MIKRGFPAVLDENTEILILGSLPSDESIRKQQYYGNPGNDFWRLVGHAIGENLQDMAYEKKLKTLKHNRIGLWDVFKAGSREGSQDSKIGDEEINDFSGLKEMVPKLRLICFNGRKAGEYEPLLRGMGYETKVLPSSSGANRRFSKNRESEWEAVFRH

SEQ ID NO: 82 - protein, 158 aa, Methanosarcina barkeri
MKKQGFPPVIDENTEILILGSLPGDVSIRKHQYYGHPGNDFWRLLGSIIGEDLQSINYQNRLEALKRNKIGLWDVFKAGKREGNEDTKIKDEEINQFSILKDMAPNLKLVLFNGKKSGEYEPILRAMGYETKILLSSSGANRRSLKSRKSGWAEAFKR

SEQ ID NO: 83 - protein, 333 aa, Mus musculus
MPARGGSARPGRGALKPVSVTLLPDTEQPPFLGRARRPGNARAGSLVTGYHEVGQMPAPLSRKIGQKKQRLADSEQQQTPKERLLSTPGLRRSIYFSSPEDHSGRLGPEFFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQLRNSLRKSTVGRSLKDRELCSGPSKLCQALAIDKSFDQRDLAQDDAVWLEHGPLESSSPAVVVAAARIGIGHAGEWTQKPLRFYVQGSPWVSVVDRVAEQMDQPQQTACSEGLLIVQK

SEQ ID NO: 84 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 85 - protein, 219 aa, Homo sapiens
KGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 86 - protein, 223 aa, Cricetulus griseus
EDHPARLGPEFFDQPAVTLARAFLGQVLVRRLADGTELRGRIVETEAYLGPEDEAAHSRGGRQTPRNRGMFMKPGTLYVYIIYGMYFCLNVSSQGAGACVLLRALEPLEGLDTMRQLRSTLRKSTVSRTLKDRELCSGPSKLCQALAIDKSFDQRDLTQDEAVWLEHGPLATGSPAVVAAARIGIGHAGEWTQKPLRFYVQGSPWVSVVDRVAEQMCQPQQTA

SEQ ID NO: 87 - protein, 219 aa, Canis lupus
KSHSAQLGSDFFDQPAVALARAFLGQVLVRRLDDGTELRGRIVETEAYLGPEDEAAHSRGGRQTPRNRGMFMKPGTLYVYIIYGMYFCLNVSSQGDGACVLLRALEPLGGLETMRQLRSTLRKGTTGRALKDRELCSGPSKLCQALAIDKSFDQRDLAKDRAVWLERSPPGPSEPAVVAAARVGIGHAGEWAQKPLRFYLRGSPWVSVVDRAAEQNAQA

SEQ ID NO: 88 - protein, 219 aa, Callithrix jacchus
KGYLTRLGSEFFDQPAVTLAQAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAIDKSFDQRDLAQDEAIWLEHGPLEPSGPTVVAAARVGIGYAGEWSRKPLRFYVRGSPWVSVVDRVAEQDAQA

SEQ ID NO: 89 - protein, 219 aa, Pongo abelii
KGHLTRLGLEFFNQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 90 - protein, 289 aa, Spizellomyces punctatus
SMNTEDDNNNNKTIHSEPGFKGLIAGFAYTGPAARASRLKLPVGANVQVDEQYKASSGSARILDKVTSDATKRRTKRSATVLDTSSKRIRAAQTITPLKEVPDYLEKDLDVVFCGFNPGIQSSTRGHHYAGSNNHFWTCLSESGLVGSTVVTYKDDARCPADFSIGFTNIVSRPTRGSSDLSMKEMSAGADPLYAKITTFRPKVCCFVGKGVYEAFSGKKKFELGLQAEKVGATALFVVPSTSGRVSAYSKEDKLLLFKELKRVLDEITASKSLFTEDAILHQPENDLS

SEQ ID NO: 91 - protein, 358 aa, Gibberella zeae
TLRQGLKQGYVWLWRLTEIVHKKWTSKQNSSGIISHIALDDTIIQSTAPMEENVADEEINDGSDIPSSPPQPATFKGRLQMSDFMFQSAEPTAKGETSPIRRSPRLNPSTLSATVAPTPISTDKRTKKRQAEDKENGVTPKKKRARPSSGYAPPSTYAHLPGLPDAIADNLLVLFIGLNPGIQTARTGHAYAHPSNLFWKLLFSSGLTPRLCSPTEDRKLPEMYSMGFTNIVARPSRNGSELSKQEMDEGVEILHEKCRKYRPESVCVVGKSIWESIWRVRHGKPVGKAFKYGWQDESENMGVIEGEWEGAKVFVSSSTSGLAATLSPAEKERIWAEIGTWAKKRRVERELEKEGNGS

SEQ ID NO: 92 - protein, 36 aa, Artificial sequence
  Synthetic peptide
EKSKNDRSKPQPSDDRDRQPPSGEDYPEWKAPGEYE

SEQ ID NO: 93 - protein, 34 aa, Artificial sequence
  Synthetic peptide
QEPKPQDQSSEVPPPPGSQKPGTKEPHDSKSSGP

SEQ ID NO: 94 - protein, 34 aa, Artificial sequence
  Synthetic peptide
PDNSSGQKLQLPQPSDKPQDSREKSDSLPSDKRD

SEQ ID NO: 95 - protein, 36 aa, Artificial sequence
  Synthetic peptide
PDNSTLQTLQLPQPTPSSTDTQQTSDTDPEDTTDVI

SEQ ID NO: 96 - protein, 30 aa, Artificial sequence
  Synthetic peptide
STSQSDGSSVPADIDQSSDSDQSSSQGQPG

SEQ ID NO: 97 - protein, 14 aa, Artificial sequence
  Synthetic peptide
AKPDDESQKPPQDD

SEQ ID NO: 98 - protein, 14 aa, Artificial sequence
  Synthetic peptide
LQLEPGPTTPEYPI

SEQ ID NO: 99 - protein, 14 aa, Artificial sequence
  Synthetic peptide
IQLPPSDTTPENPI

SEQ ID NO: 100 - protein, 12 aa, Artificial sequence
  Synthetic peptide
ESNDNSQVPPSL

SEQ ID NO: 101 - protein, 10 aa, Artificial sequence
  Synthetic peptide
SEQQEYPGSG

SEQ ID NO: 102 - protein, 10 aa, Artificial sequence
  Synthetic peptide
NNSEQQENPA

SEQ ID NO: 103 - protein, 12 aa, Artificial sequence
  Synthetic peptide
STDGSGQPKHKP

SEQ ID NO: 104 - protein, 20 aa, Artificial sequence
  Synthetic peptide
PKPSSESGERYEQQPEPPPP

SEQ ID NO: 105 - protein, 16 aa, Artificial sequence
  Synthetic peptide
KGGGGEPDEKRPSQSS

SEQ ID NO: 106 - protein, 14 aa, Artificial sequence
  Synthetic peptide
YAGGTPKEPPPPNS

SEQ ID NO: 107 - protein, 14 aa, Artificial sequence
  Synthetic peptide
PLVAGGTPFEPPPP

SEQ ID NO: 108 - protein, 14 aa, Artificial sequence
  Synthetic peptide
PQPDERSQIPDNKE

SEQ ID NO: 109 - protein, 10 aa, Artificial sequence
  Synthetic peptide
YTDEKPLPRS

SEQ ID NO: 110 - protein, 12 aa, Artificial sequence
  Synthetic peptide
SHPPQEPPQSNL

SEQ ID NO: 111 - protein, 16 aa, Artificial sequence
  Synthetic peptide
SESPSKQQPEPKSSKG

SEQ ID NO: 112 - protein, 16 aa, Artificial sequence
  Synthetic peptide
SESPTNQQPEPQWTTD

SEQ ID NO: 113 - protein, 16 aa, Artificial sequence
  Synthetic peptide
GGSKGPPPSPPPPQPE

SEQ ID NO: 114 - protein, 16 aa, Artificial sequence
  Synthetic peptide
GPLPAPPPQPPPPQPN

SEQ ID NO: 115 - protein, 14 aa, Artificial sequence
  Synthetic peptide
RPLPHDNNKQDYSK

SEQ ID NO: 116 - protein, 61 aa, Artificial sequence
  Synthetic peptide
  MISC_FEATURE (5)..(61): Amino acid is present or absent
SGGSGGSGGSGGSGGSGGSGGSGGSGGSGGSGGSGGSGGSGGSGGSGGSGGSGGSGGSGGS

SEQ ID NO: 117 - protein, 4 aa, Artificial sequence
  Synthetic peptide
SGGS

SEQ ID NO: 118 - protein, 10 aa, Artificial sequence
  Synthetic peptide
SGGSGGSGGS

SEQ ID NO: 119 - protein, 16 aa, Artificial sequence
  Synthetic peptide
SGSETPGTSESATPES

SEQ ID NO: 120 - protein, 32 aa, Artificial sequence
  Synthetic peptide
SGGSSGGSSGSETPGTSESATPESSGGSSGGS

SEQ ID NO: 121 - protein, 104 aa, Artificial sequence
  Synthetic peptide
SRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSG

SEQ ID NO: 122 - protein, 60 aa, Artificial sequence
  Synthetic peptide
GGGGSGGGGSGGGGSGGGGSGGGGSGGGGSGGGGSGGGGSGGGGSGGGGSGGGGSGGGGS

SEQ ID NO: 123 - protein, 2204 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSKRTADGSEFEPKKKRKV

SEQ ID NO: 124 - protein, 2239 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGPARGGSARPGRGALKPVSVTLLPDTEQPPFLGRARRPGNARAGSLVTGYHEVGQMPAPLSRKIGQKKQRLADSEQQQTPKERLLSTPGLRRSIYFSSPEDHSGRLGPEFFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQLRNSLRKSTVGRSLKDRELCSGPSKLCQALAIDKSFDQRDLAQDDAVWLEHGPLESSSPAVVVAAARIGIGHAGEWTQKPLRFYVQGSPWVSVVDRVAEQMDQPQQTACSEGLLIVQKSGGSKRTADGSEFEPKKKRKV

SEQ ID NO: 125 - protein, 2231 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGNDIETRDTGTKNDNSSEFNLSVKSHKRKRSFDDENLELEESREETSGGILKKAKTQSFSESLERFRFAHAGSNNEYRKTDVVKNSDTDNGLLKSAVETITLENGLRNRRVNVTKKSTLKASVKKSTLKKKNEVDPALLQGVPDYICENPYAIIVGLNPGITSSLKGHAFASPSNRFWKMLNKSKLLEGNAEFTYLNDKDLPAHGLGITNLCARPSSSGADLRKEEMQDGARILYEKVKRYRPQVGLFISGKGIWEEMYKMLTGKKLPKTFVFGWQPEKFGDANVFVGISSSGRAAGYSDEKKQNLWNLFAEEVNRHREIVKHAVSGGSKRTADGSEFEPKKKRKV

SEQ ID NO: 126 - protein, 2224 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGSKEPVSVVLPDAEHPAFPGRTRRPGNARAGSQVTGSREVGQMPAPLSRKIGQKKQQLAQSEQQQTPKEKLSSTPGLLRSIYFSSPEDRPARLGPEYFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQLRNSLRKSTVGRSLKDRELCNGPSKLCQALARSKSFDQRDLAQDEAVWLEHGPLESSSPAVVAAAAGIGHAGEWTQKPLRFYVQGSPWVSVVDRVAEQMYQPQQTACSDGALIVQKSGGSKRTADGSEFEPKKKRKV

SEQ ID NO: 127 - protein, 2064 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGIKRGFPAVLDENTEILILGSLPSDESIRKQQYYGNPGNDFWRLVGHAIGENLQDMAYEKKLKTLKHNRIGLWDVFKAGSREGSQDSKIGDEEINDFSGLKEMVPKLRLICFNGRKAGEYEPLLRGMGYETKVLPSSSGANRRFSKNRESEWEAVFRHSGGSKRTADGSEFEPKKKRKV

SEQ ID NO: 128 - protein, 2064 aa, Artificial sequence
  Synthetic polypeptide
MKRTADGSEFESPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVGGGGTGGGGSAEYVRALFDFNGNDEEDLPFKKGDILRIRDKPEEQWWNAEDSEGKRGMILVPYVEKYSGDYKDHDGDYKDHDIDYKDDDDKSGKKQGFPPVIDENTEILILGSLPGDVSIRKHQYYGHPGNDFWRLLGSIIGEDLQSINYQNRLEALKRNKIGLWDVFKAGKREGNEDTKIKDEEINQFSILKDMAPNLKLVLFNGKKSGEYEPILRAMGYETKILLSSSGANRRSLKSRKSGWAEAFKRSGGSKRTADGSEFEPKKKRKV

SEQ ID NO: 129 - protein, 19 aa, Artificial sequence
  Synthetic polypeptide
MKRTADGSEFESPKKKRKV

SEQ ID NO: 130 - protein, 21 aa, Artificial sequence
  Synthetic polypeptide
SGGSKRTADGSEFEPKKKRKV

SEQ ID NO: 131 - DNA, 20 bp, Homo sapiens
gaacacaaagcatagactgc

SEQ ID NO: 132 - DNA, 20 bp, Homo sapiens
gtcatcttagtcattacctg

SEQ ID NO: 133 - DNA, 20 bp, Homo sapiens
gcacaaccagtggaggcaag

SEQ ID NO: 134 - DNA, 20 bp, Homo sapiens
gctccagagccgtgcgaatg

SEQ ID NO: 135 - protein, 1736 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSGGGGSGPKKKRKVAAAGSEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKK

SEQ ID NO: 136 - protein, 1736 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSGGGGSGPKKKRKVAAAGSEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKK

SEQ ID NO: 137 - protein, 1736 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSGGGGSGPKKKRKVAAAGSEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKK

SEQ ID NO: 138 - protein, 508 aa, Artificial sequence
  Synthetic polypeptide
GPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSSETPGTSESATPEGGSGGSGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSGGSGGSYKLILNGKTLKGETTTEAVDAATAEKVFKQYANDNGVDGEWTYDDATKTFTVTE

SEQ ID NO: 139 - protein, 508 aa, Artificial sequence
  Synthetic polypeptide
GPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSSETPGTSESATPEGGSGGSGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSGGSGGSYKLILNGKTLKGETTTEAVDAATAEKVFKQYANDNGVDGEWTYDDATKTFTVTE

SEQ ID NO: 140 - DNA, 20 bp, Homo sapiens
gtgttccagtttcctttaca

SEQ ID NO: 141 - protein, 1425 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 142 - protein, 1425 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 143 - DNA, 23 bp, Homo sapiens
gctcagcaggcacctgcctcagc

SEQ ID NO: 144 - DNA, 23 bp, Homo sapiens
atataatgcataataaaaaactt

SEQ ID NO: 145 - DNA, 23 bp, Homo sapiens
tatgagttacaacgaacacctca

SEQ ID NO: 146 - protein, 272 aa, Latimeria chalumnae
MTSRKRKLVSALKDDKGITKLHWNQQKQQVPLLVECAKEEQHEAPSTTSKYFCGGEDRSSRLGSEFFNQPCITLAKAFLGKILVRKLADGTELRGMIVETEAYLGGEDAASHSSGRKQTARNVAMFMKPGTMYVYQIYGIYFCMNVSSQGEGAAVLLRSLEPLQGLDTMRQLRSVRKKGNQKSCKDQGLCNGPSKLCQALDIDKSFDRRDLATDCEAWMEPGPSVITEEAIVSTARIGIGYAGEWAKKPLRFYIHGNRCVSVVDKLAQQNTR

SEQ ID NO: 147 - protein, 274 aa, Alligator mississippiensis
MPRKKNQLAHLNAVQRKSTLLPAEIPGTLAVDPDGNASPLSSKYFIIEKNTSQLGSDYFNQPCISLAKSVLGQILVRKLPDGRELRGKIVETEAYLGGEDEASHSKGGKQTPRNAAMFMKPGTLYVYQIYGIYFCMNISSQGEGAAVLLRSLEPLDGLDVMQQLRSSQKKGQPKPLKDWQLCNGPSKLCQAFDINKDFDQRDLAQNPAIWLEPGPEVPGEQAVVTTARIGIGCSGEWAQKPLRFYIRGNRCVSIVDKRVERETECSYDLPVAQG

SEQ ID NO: 148 - protein, 273 aa, Columba livia
MPRKRKLLAQLSALQSNSSFPPFDALDNPNATPGVDSSPKSSKYFAIEKKTPSQLEADFFNQPCVSLAKAFLGQILVRKLPDGRELWGRIVETEAYLGGEDEASHSKGGKQTQRNAAMFMKPGTLYVYQIYGIYFCVNVSSQGEGAAVLLRSLEPLQGLDAMRELRSASRKGATKVLKDWQLCNGPSKLCQAFGIDKAFDQRDLTQDAAIWMVPGHDPPGEQDVVTTTRIGIGNRGEWAQKPLRFYLRGNKFVSVVDKKTEKEMAAMGQVSCS

SEQ ID NO: 149 - protein, 273 aa, Gallus gallus
MPRKRKLLVQLSALQSNSSIPPSDALKNPTTTPDGNSSPKSSKYFATEKKQSSQLEADFFNQPCISLAKSFLGQILVRKLPDGRELWGRIVETEAYLGGEDEASHSKGGKQTQRNAAMFMKPGTLYVYQIYGIYFCVNVSSQGEGAAVLLRSLEPLQGLDVMREMRSASRKGPAKPLKDWQLCNGPSKLCQAFGIDKAFDQRDLTRDAAIWMVPGQELPGEQDVVATTRIGIGNRGEWSQKPLRFYLRGNKFVSVVDKKMEREMAAMEPISCS

SEQ ID NO: 150 - protein, 282 aa, Sarcophilus harrisii
MFRKGRPASRMAQLSRTMLRKKPRLSESKASQSQPKLDSLGDHPLASPRSPAPEYSIYFTHQKSNSSRLGPEFFDQPAIALAQAFLGQILVRRLPDGTELRGRVVETEAYLGAEDEAAHSRGGRQTPRNKGMFMKPGTLYVYIIYGMYFCMNVSSQGEGACILLRSLEPVEGLEMMRQLRNAHRKGAARALKDRELCNGPSKLCQALAIDKSFDQRDLAEEESIWLEQGPEKPGEHTVVTATRIGINYAGEWALKPLRFYIRGNPYVSVVDRKVEQEMQASG

SEQ ID NO: 151 - protein, 234 aa, Macropus eugenii
PRSPAPEYSIYFTRPKSNSSRLGPEFFDQPAITLAQAFLGQILVRRLPDGTEVRGRVVETEAYLGAEDEAAHSRGGKQTSRNKGMFMKPGTLYVYIIYGMYYCMNVSSQGEGACILLRSLEPVEGLEMMRQLRNAHRKGAARALKDRELCNGPSKLCQALAIDKSFDQRDLAEEEALWLEQGPERPGEHSVVAAARIGINYAGEWALKPLRFYIQGNPYVSVVDRKVEQEMQAS

SEQ ID NO: 152 - protein, 319 aa, Dasypus novemcinctus
  misc_feature (210)..(210): Xaa can be any naturally occurring amino acid
QVLPHVISKCLGAETPDLSRCAVVVASPPALPRSSARSSPGARTLCASLLFRPLSRRMGQKKQRLSEAERSQSPQDTAGPPAPKGPRPGLPATPSPQRSIYFSRPQGCPARLGPEFFDQPAVPLARAFLGQVLARRLPDGTEVRGRVVDTEAYVGPEDTAAHSRGGRRTARNRAMFMPPGTLYIYVVYCMYFCMNVSSRGERGARASGDXGGLDAMRQLRALLRGAAGRAVRDRELCSGPSKLCQALAIDKSFDQRDLAADEAVWLERGPPGAAELPVVAAARVGIGSSGEWARKPLRFYFRGSPWVSVVDRTAEQDAQ

SEQ ID NO: 153 - protein, 473 aa, Erinaceus europaeus
MEAEEGVQDETESCVPDLKRQRLLTDAPRSFGVPGAAHVHPRSRVTQPPNRFPEPLPTGAFGRREAGRRAPSIPRRRRPAQPAGFRVGSEPRLGFAGGSPSPPHKQVSALRVQPAGEEGPLPCAPRSRGGPRIRAFLVACGAPRPLLTVYPHLRFQTHLADVAFRRRLWVPLLRMRKGTSLVHFLGPQEAGTQLPHRMGLKRQRLRGMEQSQGPPSPQNPNLEPPEAPGPQRSKYFLSPKAHSTRLGSEFFDQPATALARGLLGQVLVRRLSDGTELRGRIVETEAYLGPEDEAAHSRGGRQTPRNRGMFMKPGTLYVYLIYGMYFCMNISSQGDGACVLLRALEPLGGLEAMRQLRSSVRRGTAGRALRDRELCSGPSKLCQALAIDRSFDQRDLAQDEAMWLEHGSSGPTETAAVVAAARVGIGQAGEWTHKPLRFYMQGCPWVSVVDRAAERDSQADESHGAGSEPSVTK

SEQ ID NO: 154 - protein, 292 aa, Echinops telfairi
MAGWGMDSRAPSLTPLGPTQGAVHHATELLRRARQKQRLAEAEPPDTARMPPSKKPCSGPPATLSPQRSIYFLSPREPPARLGPEFFNQPAVALAQAFLGQVLVRQLADHTELRGRIVETEAYLGPDDEAAHSRGGRQTARNRGMFMKPGTLYVYIIYGMYFCMNVSSQGDGACVLLRALEPLEGLESMRQLRSSLGKGTSGRTLKDRQLCSGPSKLCQALAIDKSFDQRDLATDGAVWMEPGPPGPEPTVVAAARVGIGQAGEWTHKALRFYVQGSPFVSVVDRAAERVQP

SEQ ID NO: 155 - protein, 279 aa, Pteropus alecto
MPLRSGTQLSRKVLQKKQQPLEAERYQRLPDGAHTPSPKEPHLGPPKTLVPQLSIYFSSAKSHPARLGSDFFDQPAVSLAQAFLGQVLVRRLDDGTELRGRIVETEAYLGPEDEAAHSRGGRQTPRNRGMFMKPGTLYVYFIYGMYFCMNVSSQGDGACILLRALEPLEGLETMRQLRSTHRKGTAGRALKDRELCSGPSKLCQALAINKNFDQRDLAEDKAIWLEPGPPELREPAVVAAARVGIGYAGEWAQKPLRFYIQGSPWVSVVDRVAEQAAQA

SEQ ID NO: 156 - protein, 267 aa, Carlito syrichta
MGQKKQRLAEAEQPQGPSYAAWIPSPKEPHMGPLVTPDPHCSIYFSNSKDQLTRLGSEFFDQPAVPLARAFLGQVLVRRLANGTELRGRIVETEAYLGPEDEASHSRGGRQTPRNRGMFMKPGTLYVYIIYGMYFCMNVSSQGDGACVLLRALEPLGGLETMRQLRSTLRKGTASRALKDRELCSGPSKLCQALAIDKSFDQRDLAQDEAMWLERGSLGLSGAAVVAAARVGIGSAGEWVQKPLRFYVRGSPWVSVVDRKAEQGTQA

SEQ ID NO: 157 - protein, 293 aa, Callithrix jacchus
MPARSGAQVSALLGRTAEQTPPPGAAVNGAAGPGEPAERPQSPSYAVQAPCPKEPCLGPPTTLGPHRSIYFSSPKGYLTRLGSEFFDQPAVTLAQAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAIDKSFDQRDLAQDEAIWLEHGPLEPSGPTVVAAARVGIGYAGEWSRKPLRFYVRGSPWVSVVDRVAEQDAQA

SEQ ID NO: 158 - protein, 284 aa, Macaca fascicularis
MVTPALQMKKLKQFSRRMGQKKQRLAKAEQPHSPSDTAQAPCPKEPCLGPPTTLGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAIWLERGPLEPSEPAVVTAARVGIGYAGEWARKPLRFYVRGSPWVSVVDRVAEQDTQV

SEQ ID NO: 159 - protein, 284 aa, Macaca mulatta
MVTPALQMKKPKQFSRRMGQKKQRLAKAEQPHSPSDTAQAPCPKEPCLGPPTTLGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAIWLERGPLEPSEPAVVTAARVGIGYAGEWARKPLRFYVRGSPWVSVVDRVAEQDTQV

SEQ ID NO: 160 - protein, 284 aa, Papio anubis
SIRMLIYLFFPLQFSRRMGQKKQRPAKAEQPHSPSDTAQAPCPKEPCLGPPTTLGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAIWLERGPLEPSEPAVVTAARVGVGYAGEWARKPLRFYVRGSPWVSVVDRVAEQDTQA

SEQ ID NO: 161 - protein, 284 aa, Gorilla gorilla
MVTPALQMKKPKQFCRRMGQKKQRPARAGQPHSSSDAAQAPCPREHCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 162 - protein, 284 aa, Pan paniscus
MVTPALQMKKPKQFSRRMVQKKQRPARAGQPHRSSDAAQAPCPRERCLGPPTTAGPYRSIYFSSPKGHLTRLGLEFFNQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 163 - protein, 243 aa, Pan troglodytes
PCLREGLLRPLLPTTLGLCSRTDPFFPYPTPGRPPECSRADPFFPPSPGRVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 164 - protein, 293 aa, Pongo abelii
MPARSGAQFSRRMGQKKQRPARAGQPHSSSDAAQAPAEQPHSSSEAAQAPCPREPCLGPPTTPGPCRSIYFSSPKGHLTRLGLEFFNQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 165 - protein, 298 aa, Homo sapiens; identical to SEQ ID NO: 84

SEQ ID NO: 166 - protein, 278 aa, Canis lupus familiaris
MTARGAAQLSCRMGQKRQRVLEADRESPRGRAQTPSPGEPCLGPPATLGPRRSIYFSSPKSHSAQLGSDFFDQPAVALARAFLGQVLVRRLDDGTELRGRIVETEAYLGPEDEAAHSRGGRQTPRNRGMFMKPGTLYVYIIYGMYFCLNVSSQGDGACVLLRALEPLGGLETMRQLRSTLRKGTTGRALKDRELCSGPSKLCQALAIDKSFDQRDLAKDRAVWLERSPPGPSEPAVVAAARVGIGHAGEWAQKPLRFYLRGSPWVSVVDRAAEQNAQA

SEQ ID NO: 167 - protein, 286 aa, Ailuropoda melanoleuca
FTPKASQRICLFPLQLSRRMGQKQQRLLEAEQPQRPPDRAQTLSPVEPCLGPPAASGPQRSIYFSGPKSHSAQLGSEFFDQPAVPLARAFLGQVLVRRLDDGTELRGRVVETEAYLGPEDEAAHSRGGRQTPRNRGMFMKPGTLYVYIIYGMYFCMNVSSRGDGACVLLRALEPLGGLETMRQLRSTLRKGTAGRALKDRELCSGPSKLCQALAIDKSFDQRDLAKDKAVWLERSPPGSSEPAVVAAARVGIGHAGEWAQKPLRFYVRDSPWVSVVDRAAEQNAQA

SEQ ID NO: 168 - protein, 297 aa, Mustela putorius furo
TVGALPTRQPGGRECGGHKDRERSLAKPHQGIGQKKRLLEAEEPGSDLHGAPTPSPTEPRLGQPASLGPQRSVYFSSPKSRSARLGSEFFDQPAVALARAFLGQVLVRRLDDGTELRGRIVETEAYVGPEDEAAHSRGGRQTPRNRGMFMKPGTLYVYVIYGMYFCMNVSSRGDGACVLLRALEPLGGLETMRQLRNALRKGTVGRALKDRELCSGPSKLCQALAIDKSFDQRDLAADTAVWMEHSAPGTREPAVVAAARVGIGQAGEWAQKPLRFYVRGSPWVSVVDRTAEQNTQS

SEQ ID NO: 169 - protein, 278 aa, Felis catus
MLSRRMGQKKQRLLEAQRHQSLTDGAQMPSTMEPCLGPPAPLGPQRSIYFSSPKSHSAQLGSEFFDQPAVPLARAFLGQVLVRRLDDGTELRGRIVETEAYLGPEDAAAHSRGGRQTPRNRGMFMKPGTLYVYIIYGMYFCMNVSSRGDGACVLLRALEPLGGLETMRQLRSTLRKGAAGRALRDRELCSGPSKLCQAMAIDKSFDQRDLAKDEAVWLERSPPGSREPAVVAAARVGIGQAGEWAQKPLRFYVQGSPWVSVVDRAAEQNSQACSDKAF

SEQ ID NO: 170 - protein, 273 aa, Panthera tigris altaica
MGQKKQRLLEARRRQSLTDGAQMPSTMEPCLGPPATLGPQRSIYFSSPKSHSAQLGSEFFDQPAVPLARAFLGQVLVRRLDDGTELRGRIVETEAYLGPEDAAAHSRGGRQTPRNRGMFMKPGTLYVYIIYGMYFCMNVSSRGDGACVLLRALEPLGGLETMRQLRSTLRKGAAGRALRDRELCSGPSKLCQAMAIDKSFDQRDLAKDEAVWLERSPPGSREPAVVAAARVGIGQAGEWAQKPLRFYVQGSPWVSVVDRAAEQNSQACSDTAF

SEQ ID NO: 171 - protein, 279 aa, Odobenus rosmarus divergens
MPARGAAQLSRRMGQKKQRLLEAEQHPSPPDRAQTLSPLEPCLQPPATLSPQRSIYFSSPKSHSAQLGSEFFDQPAVPLARAFLGQVLVRRLEDGTELRGRIVETEAYVGPEDEAAHSRGGRLTPRNRGMFMKPGTLYVYIIYGMYFCMNVSSRGDGACVLLRALEPLGGLETMRQLRSTLRRGATGRALKDRELCSGPSKLCQALAIDKSFDQRDLATDKAVWLERSPPGSGEPPVVAAARVGIGHAGEWAQKPLRFYVRGSPWVSVVDRAAEQNARA

SEQ ID NO: 172 - protein, 267 aa, Leptonychotes weddellii
MGQKKQRLLEAERHPSPPDRAQMLAPLEPCLGPPAALSPQRSIYFSSPKSHSAQLGSEFFDQPAVPLARAFLGQVLVRRLDDGTELRGRIVETEAYLGPEDEAAHSRGGRQTSRNRGMFMKPGTLYVYIIYGMYFCMNVSSQGDGACVLLRALEPLGGLETMRQLRSTVRRGAAGRALKDRELCSGPSKLCQALAIDKSFDQRDLATDKAMWLERSPPGSSEPAVVAAARVGVGRAGEWAQKPLRFYVRGSPWVSVVDRAAEQNARA

SEQ ID NO: 173 - protein, 277 aa, Orcinus orca
MGQKKQRLLEAKRHQSPPDGTRTSSPKEPRLEPPTTLGPQRSIYFSSLKGRPGRLGSEFFDQPAVSLARAFLGQVLVRRLDDGTELRGRVVETEAYLGPEDEAAHSRGGRQTPRNRGMFMKPGTLYVYLIYGIYFCMNVSSQGDGACVLLRALEPVGGLEAMRQLRHTLRKGVAGRALKDLELCNGPSKLCQALAIDKSFDQRDLATDEAVWLERGPLGPSEPAVVAAARVGVGSAGEWALKPLRFYVQGSPWVSVVDRAAKRNTQARAKASRDEDF

SEQ ID NO: 174 - protein, 277 aa, Tursiops truncatus
MGQKKQRLLEAKRHQSPPDGTRTSSPKEPRLEPPTTLGPQRSIYFSSLKGRPGRLGSEFFDQPAVSLARAFLGQVLVRRLDDGTELRGRVVETEAYLGPEDEAAHSRGGRQTPRNRGMFMKPGTLYVYLIYGIYFCMNVSSQGDGACVLLRALEPLGGLEAMRQLRHTLRKGVAGRALKDLELCNGPSKLCQALAIDKSFDQRDLATDEAVWLERGPLGPSEPAVVAAARVGVGSAGEWALKPLRFYVQGSPWVSVVDRAAKRNTQARAKASRDEDF

SEQ ID NO: 175 - protein, 277 aa, Balaenoptera acutorostrata scammoni
MGQKKQRLLEAKRHQSPPGVTRTASPKEPRLGPPMTLGPQRSIYFSSLKGRPARLGSEFFDQPAVPLARAFLGQVLVRRLDDGTELRGRVVETEAYLGPEDEAAHSRGGRQTPRNRGMFMKPGTLYVYLIYGMYFCMNVSSQGDGACVLLRAVEPLGGLEAMRQLRHTLRKGAAGRALKDLELCNGPSKLCQALAIDKSFDQRDLATDEAVWLERGPLGPSEPAVVAAARVGIGHAGEWALKPLRFYVQGSPWVSVVDRAAERDAQARAKANQDEDF

SEQ ID NO: 176 - protein, 993 aa, Trichechus manatus latirostris
MGDGAEAEAVGRGLEPSCPARSRRRDVLIRPKAIFAARRSWRNPAGLGRPRERLGKLREESPVRPGRDSPQTGPQIQSLDHRPDLGPHPGRRARSRPGTAPAEDGMPWSEGRAHRGRARPEGAAALTQGSGMRAGAPPTFPAPVTSSKEAARHRSRAAEGGLRGHLRLGAVRKQGPSSEVSGAAEPSETQQAEAAEPLPVSTLCPAPGLSVCPPSLVLELHTSSLHLPSPLKIPTSPRNCHHELDALKAMVASQPNWGDRCTGQCEHARQDCKLSTETSRGNSPRGLGQLSSGCRGRPQLGAGDPTWTCTHAPLFTLHETLKTWRCRTDVRTALELLDPSSRPPWNPWLSFQATLHHPRRQSCRVDWDQPWLFGEEAERTEEGQPLACTTSPHPSWLALQATASGCVRVLQEENPDVYEERGMRSSHSPAPGLRQPDERRGGDPTGHPRNMDLASPGSLAGRSALLELLTAPTEHSERSATYPPQSHDIPEQGPSKTGSRFMLDRFSWWSDHGLRAPPLPEAESAPSVRPCLRPAAPPRRRRLHPRPRRRFRSCGRGGRLSCVCSGFDSGVGSAPGAPDRRSHLMPARSGAQRQAWEVRPRGAQAHSSGCGLSKPLPQTAQDLQADSNARCGTGEAAAWRSLSPRAESGAETRASGALGQVLQPMALRCVSRVRGAQPSLQPRPFHTWSIVATLLLPACPHDHCPRACRCPALGHVHQLSRRVGQKKQRLSEAERSRSLPDVARTPSPEEPCSGPHTCLGPPATTGPQRSIYFLSPKDHPARLGSEFFDQPGVRLARALLGQVLVRRLADNTELRGRIVETEAYLGPEDEAAHSRGGRQTARNRGMFMKPGTLYVFIIYGMYFCLNVSSQGDGACVLLRALEPLGGLETMQRLRSTLGKGASGRALKDRELCNGPSKLCQALAIDKSFDQRDLATDGAVWMECGPPGPKPAVVAAARVGVSRAGEWAQKPLRFYVRGSPFVSVVDRTAEQMQA

SEQ ID NO: 177 - protein, 274 aa, Loxodonta africana
FPLQLSRRVGQKKQRLSDAETSQILPDAARMPYPKEPCSGPHACLGPPTTTGPQRSIYFLNHPARLGSEFFDQPGAHLARAFLGQVLVRRLTDNTELRSRIVETEAYLGPEDDAAHSRGGRQTARNRGMFMKPGTLYVYTIYGMYFCLNVSSRGDGACVLLRALEPLEGLETMRRLRSTLSKGASGRAFKDHELCSGPSKLCQALAIDKSFDQRDLATDGAMWMERGPPGPEPVVVAATRVGIGCKGEWAQKLLRFYVLGNPFVSMVDRAAEQM

SEQ ID NO: 178 - protein, 277 aa, Orycteropus afer afer
MPASSEARLSRREGLKKQRLSVAERSRSKVDVARMPPLEEPCSGLPATPGPQRSIYFWNPKDHPTRLGPEFFDQPGVSLARAFLGQVLVRRLADDTELRGRIVETEAYLGPEDAAAHSRGGRQTARNRGMFMKPGTLYVYIIYGMYFCLNVSSQGDGSCVLLRALEPLGGLETMRQLRSTLRKGASSRALKDRELCNGPSKLCQALAIDKSFDQRDLTTDGAMWMERGPPGPEPSVVAAARVGVGRAGEWAQKPLRFYVRGSPFVSVVDRTAEQTQT

SEQ ID NO: 179 - protein, 292 aa, Sus scrofa
APEVIVCPSPRQLSRRMGQKKQRLLTAKRHQAPPDGAQISSSKEPRMAPPMTPGPQRSIYFSSLKGHPARLGSEFFDQPAVPLARAFLGQVLVRHLGDGTELRGRIVETEAYLGPEDQAAHSRGGRQTPRNRGMFMRPGTLYVYLIYGMYFCMNVSSRGDGACVLLRALEPLGGLEAMRQLRHTVRKGAASRALKDRELCSGPSKLCQALAIDKSFDQRDLATDEAVWLERGPSGSGEPAVVAAARVGIGHAGEWAQKPLRFYIQGSPWVSVVDRAAERDAQAGHRPAHEEF

SEQ ID NO: 180 - protein, 296 aa, Bos taurus
LVAPVLQMRSPFQLSCTMGQKKQRALEAKRHQNPSDGTQTPSPKELHLGPPATLGPTRSIYFSSPEGRPARLGSAFFDQPAVSLARAFLGQEQILVRRLDDGTELRGRIVETEAYLGPEDEAAHSRGGRQTPRNRGMFMKPGTLYVYLIYGMYFCMNVSSRGDGACVLLRALEPLGGLEAMRQLRHALRKGAAGRALKDRELCNGPSKLCQALAIDRSFDQRDLARDESVWLEQGPPEPSEPAVVAAARVGIGQAGEWVQKPLRFYIRGSPWVSVVDRAAERDTQTGARACSHKDF

SEQ ID NO: 181 - protein, 272 aa, Ovis aries
FPFQLSCTMGQKKQRASDAKRHQSPSDGTQTPSPKELHLGPPTTLGPTRSIYFSSPEGRPARLGSAFFDQPAVSLARAFLGQQILVRRLDDGTELRGRIVETEAYLGPEDEAAHSRGGRQTPRNRGMFMKPGTLYVYLIYGMYFCIMNVSSQGDGACVLLRALEPLGGLEAMRQLRHALRKGAAGRALKDRELCNGPSKLCQALAIDRSFDQPAPSEPAVVAAARVGIGQAGEWAQKPLRFYVQGSPWVSVVDRAAERDTQAGARACSHKDF

SEQ ID NO: 182 - protein, 589 aa, Ochotona princeps
MDFPEFGRGQSYMARSLRMPKLPQALTGPQRPPYRGLPGAAPPAALAEDTARLPAHPTGSAPGPHPPEHAAGPPGSGQCAGSAAGTRYFCSFVSGDPGGWARLGKLREEKCGRLSRPGAPWDALTHRRRQSRGGAAPLAGRAPESPPARECHGEGRARRGRAALTQGSGMHAASSGKAAGQRGRGAQLPGHLWLRRARSARPELLGVCWATGAEGSFSPTHKPEVAPPGAAPPPAVPVRRRRRAASEDGGARRGAGERVRGSRGGRGFRVAADNDPMGLQLSGGCVHSRSLAETLPTDPSPGPHALPGLATASVPNASSFCPLPPQLSQKVGRKKRRLAEGRTELQERPLAEALHSPGPQRSIYFMNPKDSPARLGTEFFNQPAVPLARAFLGQVLVRRLADGTELRGRIVETEAYVGPEDEAAHSRGGRQTPRNRGMFMRPGTLYVYIIYGMYCCMNVSSRGDGACVLLRALEPLGGLDAMRQLRCALRKGTTGRTLKDRELCSGPSKLCQALAIDKSFDQRDLAQDEALWLERSTPGPGVPTVVAATRVGIGQAGEWAQKPLRFYIQGSPWVSVVDRMAEQRACSHE

SEQ ID NO: 183 - protein, 270 aa, Oryctolagus cuniculus
FLLQLSQKIGHKKQRLAEADLQRSPLDAAPIPGPEEPRLGRPASLGPQRSVYFSRLKDRPARLGSEFFNQPAVPLAQAFLGQVLVRRLADGTELRGRIVETEAYVGPEDEAAHSRGGRQTARNRAMFMKPGTLYVYLIYGMYFCMNVSSQGDGACVLLRALEPLGGLETMRQLRSTVRKGTASRTLKDRELCSGPSKLCQVEHGPPGPSASAVVAAARVGIGHTGEWAQKPLRFYVRGSPWVSVVDRVAEQNMQRPKKPACGPDLPMGVR

SEQ ID NO: 184 - protein, 325 aa, Cricetulus griseus
MRARGRAGVCARLGRGSLKPMSVSLPPDTNQPLFPGRARRPGRARAGSRVTGCREAGQMPAPLSQKIGQKKLQLAESQQQQIPKDRPPSSLGLQRSIYFSSPEDHPARLGPEFFDQPAVTLARAFLGQVLVRRLADGTELRGRIVETEAYLGPEDEAAHSRGGRQTPRNRGMFMKPGTLYVYIIYGMYFCLNVSSQGAGACVLLRALEPLEGLDTMRQLRSTLRKSTVSRTLKDRELCSGPSKLCQALAIDKSFDQRDLTQDEAVWLEHGPLATGSPAVVAAARIGIGHAGEWTQKPLRFYVQGSPWVSVVDRVAEQMCQPQQTA

SEQ ID NO: 185 - protein, 327 aa, Peromyscus maniculatus bairdii
MRARGRAVLSAGLGRGALKPVSVTLPPDTDQPLFPGRARRPGNARAGSRVTGRREAGQMPAPLSRKIGQKKQRLAESQQQQQQIPKERPPSTLGLQRSIYFSSPEDHPARLGPEFFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQFRNTRRKSPVSRTLKDRELCSGPSKLCQALAIDKSFDQRDLAQDEAVWLEHGPLESRSPAVVAAARIGIGHAGEWTQKPLRFYVQGSPWVSVVDRVAEQMYQPQQTA

SEQ ID NO: 186 - protein, 333 aa, Mus musculus; identical to SEQ ID NO: 83

SEQ ID NO: 187 - protein, 329 aa, Rattus norvegicus
MRGRGGTARLGRGSLKPVSVVLPDTEHPAFPGRTRRPGNARAGSQVTGSREVGQMPAPLSRKIGQKKQQLAQSEQQQTPKERLSSTPGLLRSIYFSSPEDRPARLGPEYFDQPAVTLARAFLGQVLVRRLADGTELRGRIVETEAYLGPEDEAAHSRGGRQTPRNRGMFMKPGTLYVYLIYGMYFCLNVSSQGAGACVLLRALEPLEGLETMRQLRNSLRKSTVGRSLKDRELCNGPSKLCQALAIDKSFDQRDLAQDEAVWLEHGPLESSSPAVVAAARIGIGHAGEWTQKPLRFYVQGSPWVSVVDRVAEQMYQPQQTACSDCSKVK

SEQ ID NO: 188 - protein, 275 aa, Cavia porcellus
FPLQLSQRMGQKKKLAEAEQQQSPTDTAHKPSFKKPRLGPPLTLGSQRSIYFCQSPKDHSARLGSEFFDQPAVSLARALLGQVLVRQLGDGTELRGCIVETEAYLGPEDEAAHSRGGRQTPRNRSMFMKPGTLYVYLIYGMYFCMNVSSQGDGACVLLRALEPLGGLETMRQLRSTLRKGTISRALKDRELCSGPSKLCQALAIDKSFDQRDLAQDEAIWLEHGSLESSAPAVVTAARIGIGRAGEWAQKPLRFYIRGNPWVSVVDKGAEQNTQA

SEQ ID NO: 189 - protein, 330 aa, Octodon degus
MQIFVKTLTCKTITLEVEPSDTIENVKAKIQDKEGIPPDQQPRGRASGQARGPLPAPSTRRLKQKKKLAKAEEQQSQADTAQMPSLKKPYLGPPLTMGSQHSIYFCQSLKDHSARLGSEFFDQPAISLARAFLGQVLVRRLGDGTQLRGCIVETEAYLGPEDEAAHSRGGRQTPRNRSMFMKPGTLYVYIIYGMYFCMNVSSQGDGACVLLRALEPLQGLETMRQLRSTLRKGTISRALKDRELCSGPSKLCQAFAIDKSFDQRDLAEDEAVWLERGSQEPSASAVVAAARIGIGHAGEWAQKPLRFYIRGNPWVSVVDKVAEQTHKPEQ

SEQ ID NO: 190 - protein, 302 aa, Heterocephalus glaber
MSAVAFYLCLITTHELSQRMGQKKKQAEAEQQQSPTDTTWMPSSKKSCLRPPLILGSQYSIYFSQSPKAHCARLGSEFFDQPAVSLARAFLGQVLVRRLGDGTELRGCIVETEAYVGPEDEAAHSRGGRQTPRNRSMFMKPGTLYVYLIYGMYFCMNVSSQGDGACVLLRALEPLGGLETMRQLRSTLRKGTISRALKDRELCSGPSKLCQALAIDKSFDQRDLAQDEAVWLERGSLEPSASAVVAAARIGIGCAGEWAQKPLRFYIRGSPWVSVVDKVAEQDTQPEQSACLDSLFNCLKAK

SEQ ID NO: 191 - protein, 279 aa, Monodelphis domestica
MAQLSRTILRKKRRLSELKASQSQPKLDSLGDHPLAMPRSPAPEYSIYFTGQKSCRSRLGCEFFDQPAITLARAFLGQVLVRRLPDGTEVRGRVVETEAYLGAEDEAAHSRGGRQTPRNKGMFMKPGTLYVYIIYGMYFCMNVSSQGEGACILLRSLEPVEGLEIMRQLRNAHRKGAARALKDRELCNGPSKLCQALAIDKSLDQKDLAEEETIWLEEGPEKPGEDTVVAAARIGINYAGEWAQKPLRFYIQGNPYVSVVDRKVEREMQATAFTESVAC

SEQ ID NO: 192 - protein, 293 aa, Pelodiscus sinensis
MRLGMYLEFFLTENKYPSQSLRFSRMMPRKRRQLIPLNAVQSKPDFSPADTSGSLTVVLDGNSSPISSKYFCEEKRTSSRLGTDFFNQPCISLAKSFLGQILVHKLPDGRELQGRIVETEAYLGGEDEASHSKGGKQTARNAAMFMKPGTLYVYQIYGIYFCMNVSSQGAGAAVLLRSLEPLQGLDTMRQLRSAHRKGSAKPLKDWQLCNGPSKLCQALDINKSFDQKDLIHDPAIWMEPGSEALEQAVVTAARIGVNYGGEWAQKPLRFYIQGNKCVSVIDKKVEREHGAVL

SEQ ID NO: 193 - protein, 295 aa, Saimiri boliviensis boliviensis
MPARSGAQVSALLGRTAEQTAHPKSSGRTGQKKQQVDKAERPQSPSYAAQAPCPKEPRLGPSTTMGPHRSIYFSGPKGHLTRLGSEFFDQPAVTLAQAFLGQVLVRRLPNGTELRGRVVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAIDKSFDQRDLAQDEAIWLECGPLEPSGPAVVAAARVGIGYAGEWARKPLRFYVRGSPWVSVVDRVAEQDAQA

SEQ ID NO: 194 - protein, 693 aa, Elephantulus edwardii
MLPVVWTEGSGEVLQAPAFGVDRWGQGLRPEGRSTPPAWVALLLLDTLLSVDPGKFHPLNWSFNQETPPAAAGRETGGGGVVLRGASNVGTSPGSDPSRCPGPSAVGRGQEPSCPARSGRWDVLIRPKAIFAARRSGRNPARLGRLRGLLGNSRRKVCAGRVGTRRSSYPGSWPGPQAQSQTPDLRPRAQDSESWISDPAQPSALGATSGPRGAEDRPRAERVQPRIPLGRPPRRVSPHTHRRRRGSWILGGAAAGREGARAESPPALPSARPGMPWSEGRARRGRARPEGAASLTQDSGMREGAPPNPCHHLEEGCRPAVEGPTGPPVAGAGITWEERLACEHRYEKRVRGGQHPRQRSQRAAHALPPDCAGAGLILDKAALPGLRSWQDVYRCVFRGPFRSGLPPWIATRPSHLMPARGGAQLFRKIRQKKQRLMAAQRSQSPSKEAGTLLHKKTHLGSPATVGPQRSIYFLSPQEFPARLGPEFFDQPGITLAQAFLGQVLVRRLDDGTELRGRIVETEAYLGPEDEAAHSRGGRQTTRNRGMFMKPGTLYVYIIYGMYFCLNVSSQGEGACVLLRALEPLGGLESMRQLRTTLGKGTSGRALKDRELCNGPSKLCQALAIDKTFDQRDLATDGAVWMEHGPPGPEPAVVAAARVGIGRAGEWTQKPLRFYMRGSPFVSVVDKTAEQMQT

SEQ ID NO: 195 - protein, 267 aa, Ursus maritimus
MGQKKQRLSEAEQPQRLPDRAQTLSPMEPCLGPPAALGPQRSIYFSGPKSHSAQLGSEFFDQPAVPLARAFLGQVLVRRLDDGTELRGRIVETEAYLGPEDEAAHSRGGRQTPRNRGMFMKPGTLYVYIIYGMYFCMNVSSRGDGACVLLRALEPLGGLETMRQLRSTLRKGTAGRALKDRELCSGPSKLCQALAIDKSFNQRDLAKDKAVWLERSPPGSSEPAVVAAARVGIGHAGEWAQKPLRFYVRGSPWVSVVDRAAEQNAQD

SEQ ID NO: 196 - protein, 275 aa, Eptesicus fuscus
MPVRSAAQLSRKLGQKKQRLLEAEQHQSPPDGTPTPSPKEPRLALGPQRSIYFSSPRDPPARLGLDFFDQPAVPLARAFLGQVLVRRLDDGTELRGRIVETEAYLGPEDEAAHSRGGRQTPRNRGMFMKPGTLYVYFIYGMYFCMNVSSQGDGACVLLRALEPLGGLETMRQLRSSYRKGSTGRALKDRELCSGPSKLCQALAIDKSFDQRDLTTDKAVWLEHSPAGPREPAVVAAARVGIGNAGEWTQKPLRFYIQGSPWVSVVDRVAEQNTQV

SEQ ID NO: 197 - protein, 211 aa, Otolemur garnettii
MMEWWDKALARLGHLAHSVLVRRLPNGTELRGRVVETEAYLGPEDEAAHSRGGRQTPRNRGMFMKPGTLYVYIIYGMYFCMNVSSRGDGACILLRALEPLGGLETMRQLRSTLRKGTACRILKDRELCSGPSKLCQALAIDKSFDQRDLAKDEALWLERGSLGPSEQAVVAAARVGIGYSGEWAQKPLRFYIQGSPWVSVVDKVAEQDARA

SEQ ID NO: 198 - protein, 266 aa, Chinchilla lanigera
MRQKKKLAEAEQQSPTDTDQMPSSKKAYLGPRLTLGSQRSIYFCQNPKDHSARLGSEFFDQPAVSLARAFLGQVLVRRLGDGTELRGCIVETEAYLGPEDEAAHSRGGRQTPRNRSMFMKPGTLYVYLIYGMYFCMNVSSQGDGACVLLRALEPLGGLETMRQLRSTLRKGTINRALKDRELCSGPSKLCQALAIDKSFDQRDLAEDEAMWLERGSLEPSALAVVAATRIGIGRAGEWAQKPLRFYIRGNPWVSVVDKTAEQDTQA

SEQ ID NO: 199 - protein, 274 aa, Alligator sinensis
MPRKKNQLAHLNAVQRKSTLLPAEIPGTLAVDPDGNSSPLSSKYFIIEKNTSQLGSDYFNQPCISLAKSVLGQILVRKLPDGRELRGKIVETEAYLGGEDEASHSKGGKQTPRNAAMFMKPGTLYVYQIYGIYFCMNISSQGEGAAVLLRSLEPLDGLDVMQQLRSSQKKGQPKPLKDWQLCNGPSKLCQAFDINKDFDQRDLAQNPAIWLEPGPEVLGEQAVVTTARIGIGCSGEWAQKPLRFYIRGNRCVSIVDKRVERETECSYDLPVAQG

SEQ ID NO: 200 - protein, 267 aa, Sorex araneus
MGLKKQRFLEAEQPQNLQDGAQIPAPKEPCLRLPETSGLQRSIYFSSPKDPPHRLGNEFFDQPAVSLARALLGKVLVRRLNDGTELRGRIVETEAYLGPEDEAAHSRGGRQTPRNRGMFMKPGTLYVYIIYGMYFCMNVSSQGDGACVLLRALEPLEGQETMRKLRMTHRKSIASRALKDRELCSGPSKLCQALAIDKSFDQQDLAKDEAVWLEHSPPALSEPAVVAAARVGIGHAGEWTQKPLRFYVRGSPWVSVVDKAAERETQA

SEQ ID NO: 201 - protein, 245 aa, Ictidomys tridecemlineatus
ETAQSPSPKEPHLRPASSLGPQRSIYFSSPKGHPARLGTEFFDQPAIPLARAFLGQVLVRRLADGTELRGRIVETEAYLGPEDEAAHSRGGRQTTRNRGMFMKPGTLYVYIIYGMYFCMNVSSQGDGACVLLRALEPLGGLETMRQLRNNLRKGTLSRTLKDRELCNGPSKLCQALAIDKSFDQRDLAQDEAMWLECGLLGPSRPAVVAAARVGIGNAGEWTQKPLRFYFQGSPWVSVVDKAAEQ

SEQ ID NO: 202 - protein, 440 aa, Jaculus jaculus
MPARSGAQVSARQNPVTVTCPPTPAGLRFQDETAARRGARAGPRVTRCRGAGLRPDTVSGSFSVAESEPTASWHRGSGCRDSHVSVHSRRPGSLAPASNISRKMGHKKQRLTETESQLPPSDTANSSPKERLPSTLGLQRSIYFSSPKAHPARLGLEFFDQPAIALARAFLGQVLVRRLADGTELRGRIVETEAYLGPEDEAAHSRGGRQTPRNRGMFMKPGTLYVYIIYGMYFCLNVSSQGEGACVLLRALEPLEGVEMMRQLRSTLRKGTISRVLKDRELCSGPSKLCQALAIDKSFDQRDLAQDEAVWLECGPQGPNESAIVAAARVGIGHAGEWTQKPLRFYVRGSPWVSVVDRVAERMYRPEQRASSHRLLLVCFSRKMSISQPQPPNPISVPTDISSRPGKLSTEYGHQQRTKMYKYMQPEAEVLCSLLSYRLF

SEQ ID NO: 203 - protein, 273 aa, Haliaeetus leucocephalus
MPRKRKLLAQLSALQSNSSFPPFDALENLNATPDGDSSPKSSKYFAIEKKKSSQLEDDFFNQPCISLAKSFLGQILVRKLPDGRELWGRIVETEAYLGGEDEASHSKGGKQTQRNAAMFMKPGTLYVYQIYGIYFCVNVSSQGEGAAVLLRSLEPLQGLDAMRELRSASKKGPTKLLKDWQLCNGPSKLCQAFGIDKAFDQRDLTQDAAIWMAPGHDLPGEQDVVATTRIGIGNRGEWAQKPLRFYLRGNKFVSVVDKKREREMAAMGHSSYS

SEQ ID NO: 204 - protein, 328 aa, Myotis lucifugus
QALPGGIPRGQGSLPPLSACCMPAKASPPALGRSAVPRTARVVSLVSTHPCVSDLLRPLSRKLGLKKQRLLGAEQHQSPPDGTPTPSPKEPRLGLPNTPGPQRSIYFSSPRDPPARLGLDFFDQPAVPLARAFLGQVLVRRLDDGTELRGRIVETEAYLGPEDEAAHSRGGRQTPRNRGMFMKPGTLYVYFIYGMYFCMNVSSQGDGACVLLRALEPLGGLENMRQLRSTSRKGSTGRALKDRELCSGPSKLCQALAIDKSFDQRDLTTDKAVWLEHSPPGPREPAVVAAARVGIGNAGEWAQKPLRFYIQGSPWVSVVDRGAEQDTQ

SEQ ID NO: 205 - protein, 711 aa, Pantholops hodgsonii
MWQLPACEGCDTEPFIWYKRKPYVRIHTPKLHTREEKLVRDRFTATAIAEVSPIPREDGWDSDDPEKSHPEVPPSELEFRLETPPTGGGRAGEPGAPSQVGAPQQRRQHPLRALPVLELTRWPRAHLCRPELDTSLAARAGAGGVLSGAQCLGSPPALAKAGRPVRQVSLQRMLQGIQNPSVTQTLAPSGQELALPPQPAPPQAVLSGCKLPSQRGWPPPASFGPPPRDPLCPHARETPSSLCCKPLPLTALAAQPQEGATRRGAARAARMPWARRPQKPPPEVAPLQPQGQRSPSGSICCPAQRHREKAHEQCAGKYPWGPCEVGVHSWAGAWACAGAEPLGWSEEEEELETRALPAGLADQASSTSWPVTGPDVTGRLAREATSAQPSLQCVSKKDEHSALKPSATELCKCCVQTAHGAEWLPCHCLYLSCTMGQKKQRTLDTKRHQSPSDGTQTPSPKELHLGPPATLGPMRSIYFSSPEGRPARLGSAFFDQPAVSLARAFLGQILVRRLDDGTELRGRIVETEAYLGPEDEAAHSRGGRQTPRNRGMFMKPGTLYVYLIYGMYFCMNVSSQGDGACVLLRALEPLGGLDAMRQLRHALRKGTAGRALKDRELCNGPSKLCQALAIDRSFDQRDLARDESMWMEQGPPEPSEPAVVAAARVGIGQAGEWAQKPLRFYVWGSPWVSVVDRAAERDTQAGARACSHKDF

SEQ ID NO: 206 - protein, 273 aa, Ficedula albicollis
MPRKRKLLAQLSALQSTTSFPQICAVEQLNTTPGADPSPQSSKYFVIEKQKSPQLQEDFFNQPCVSLAKSFLGQILVRKLPDGRELWGRIVETEAYLGGEDEASHSKGGKQTQRNAAMFMKPGTLYVYQIYGIYFCMNVSSQGEGAAVLLRSLEPLQGLDAMRELRRAARKAPSRLLKDWQLCNGPSKLCQAFGIDKAFDQRDLTQDDAIWMVPGQDPPGEQDVVATTRIGIGNRGEWAQKPLRFYLRGNRFVSVVDKKMEREMAARGHSPGS

SEQ ID NO: 207 - protein, 279 aa, Chlorocebus sabaeus
MPARSGVQFSRRMGQKKQRLAKAEQPHSPSDTAQAPCPKEPCLGPPTTLGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAIWLEHGPLEPSEPAVVTAARVGIGYAGEWARKPLRFYVRGSPWVSVVDRVAEQDTQA

SEQ ID NO: 208 - protein, 279 aa, Rhinopithecus roxellana
MPARSGAQFSRRMGQKKQRLAKAEQPYSPSDTAQAPCPKEPCLGPPTTLGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAIWLECGPLEPSEPAVVTAARVGIGYAGEWARKPLRFYIRGSPWVSVVDRVAEQNTQA

SEQ ID NO: 209 - protein, 527 aa, Bos mutus
MPLGEVRSPELPFTPAACSPSHCKRSSSRGLRPRWEVGVPGRGASGKRGSPGQPPPRPRRTRAGARPAPLRPPARSRPSALLRAGAGSTPRPGGASGWAPGWAPRRRVRSRGGPLEAYASRGPGECAPREHVPPRAHGRRTGFGLRPSPESQPHRSFDGGLAGVLGACFQAAVPCPPLGETQPGKRPSPGFAQSSALWVGQGRDPESARGLGQAESHTRAEEQGRSVPEREPTLGPPGPRLGGARQLSCTMGQKKQRALEAKRHQNPSDGTQMPSPKELHLGPPATLGPTRSIYFSSPEGRPARLGSAFFDQPAVSLARAFLGQILVRRLDDSTELRGRIVETEAYLGPEDEAAHSRGGRQTPRNRGMFMKPGTLYVYLIYGMYFCMNVSSRGDGACVLLRALEPLGGLEAMRQLRHALRKGAAGRALKDRELCNGPSKLCQALAIDRSFDQRDLARDESVWLEQGPPEPSEPAVVAAARVGIGQAGEWAQKPLRFYIRGSPWVSMVDRAAERDTQTGARACSHKDF

SEQ ID NO: 210 - protein, 325 aa, Microtus ochrogaster
MRARGRADLSTRLGRGALKPVSVTLPPDTDQPLFPGRARRPGSARAGSRVTGCREAGQMPEPLSRKIGQKKQRLAESQQQQIPKERPPSALGLQRSIYFSSSEDHPARLGPEFFDQPAVTLARALLGQVLVRRLADGTELRGRIVETEAYLGPEDEAAHSRGGRQTPCNRGMFMKPGTLYVYIIYGMYFCLNVSSQGAGACVLLRALEPLEGLETMRQLRNNLRKSTAGRTLKDRELCSGPSKLCQALAIDKSFDQRDLAQDEAVWLERGPVESSSPAVVAAARIGIGHAGEWTQKPLRFYIQGSPWVSVVDRVAEQMYQPQQTA

SEQ ID NO: 211 - protein, 463 aa, Bubalus bubalis
MHILARHRPWYLPTPPHHPLPSSFPRPSALHVHPKTTTAPAGAQSRLLRDQASWRSDHQPVEECVLRLRGGGWTRWTTVQVWRGEWGHATGRAAAGFVQDGRWGARQGRQRETRVPRPAPGARPAPLRSAPPPAAGLPPSSAQAPAPPPDQAVLPGGLLGGLRAGGSEAAAGRRKPARRGAQLSRTMGQKKQRALEAKRHQSPSDGTQTPSPKELHLGPPATVGPTRSIYFSSPEGRPARLGSAFFDQPAVSLARAFLGQILVRRLDDGTELRGRIVETEAYLGPEDEAAHSRGGRQTPRNRGMFMKPGTLYVYLIYGIYFCMNVSSRGDGACVLLRALEPLGGLEAMRQLRHALRKGAAGRALKDRELCNGPSKLCQALAIDRSFDQRDLARDESVWLEQGPPEPSEPAVVAAARVGIGQAGEWAQKPLRFYVRGSPWVSVVDRAAERDTQTGARACSHGDF

SEQ ID NO: 212 - protein, 498 aa, Myotis brandtii
MGQSGGCTFRVLYKHGHISMILSYRATARAPEGLEGTPSQVEGGDYGCIGDTRQEGGCPVLMPVAPAATHVSPPLPGSQPDRTVSPCPAFLTPARDKQALPTRLGWQSMRQCPPGVQGLGSAPKHVMAGHPVLAGPFPQWMLQGATQARFMTQTFTHSCREHQLSLAHSGEPPEEYPLRSLPREGDSSAGQSLGWEVGGCGGLEDRGTNPWLFGEVAEMGQASQGPELSRKLGLKKQRLLGAEQHQSPPDGTPTPSPREPRLGLPNTLGPQRSIYFSSPRDPPARLGLDFFDQPAVPLARAFLGQVLVRRLDDGTELRGRIVETEAYLGPEDEAAHSRGGRQTPRNRGMFMRPGTLYVYFIYGMYFCMNVSSQGDGACVLLRALEPLGGLETMRQLRSTSRKGSTGRALKDRELCSGPSKLCQALAIDKSFDQRDLTTDKAVWLEHSPPGPREPAVVAAARVGIGNAGEWAQKPLRFYVQGSPWVSVVDRGAEQDTQV

SEQ ID NO: 213 - protein, 277 aa, Lipotes vexillifer
MGQKKQRLLEAKRHQSPPDGTRTASPKEPRLEPPTTLGPQRSIYFSSLKGRPARLGSEFFDQPAVPLARAFLGQVLVRRLDDGTELRGRIVETEAYLGPEDEAAHSRGGRQTPRNRGMFMKPGTLYVYLIYGMYFCMNVSSQGDGACVLLRALEPLGGLEAMRQLRHTLRKGVAGRALKDLELCNGPSKLCQALAIDKSFDQRDLATDEAVWLEQGPLGPSEPAVVAAARVGVGRAGEWALKPLRFYVQGSPWVSVVGRAAERDTQARAKASRDEDF

SEQ ID NO: 214 - protein, 273 aa, Nipponia nippon
MPKKRKLLAQLSALQSNSSFPSFDALENRNVTPDGDSSPKSSKYFAIEKRNSSRLEADFFNQPCISLAKSFLGQILVRKLPDGRELWGRIVETEAYLGGEDEASHSKGGKQTQRNAAMFMKPGTLYVYQIYGIYFCVNVSSQGEGAAVLLRSLEPLQGLDAMRELRSASRKGPTKLLKDWQLCNGPSKLCQALGIDKAFDQRDLTQDAAIWMVPGHDLPGEQDVVVTTRIGIGNRGEWAQKPLRFYLRGNKFVSVVDKKTEREMAAMGHFSCS

SEQ ID NO: 215 - protein, 283 aa, Pteropus vampyrus
GVALILQMGKLRQLSRKVLQKKQQPGAERYQRLPDGAHTPSPKEPHLGPPKTLVPQLSIYFSSAKSHPARLGSDFFDQPAVSLAQAFLGQVLVRRLDDGTELRGRIVETEAYLGPEDEAAHSRGGRQTPRNRGMFMKPGTLYVYFIYGMYFCMNVSSQGDGACILLRALEPLEGLETMRQLRSTHRKGTAGRALKDRELCSGPSKLCQALAINKNFDQRDLAEDKAIWLEPGPPELREPAVVAAARVGIGYAGEWAQKPLRFYIQGSPWVSVVDRVAEQAAQA

SEQ ID NO: 216 - protein, 273 aa, Pseudopodoces humilis
MPRKRKLLAQLSALQNNTSFPQIDAVEQLNTTPGTDPSPKSSKYFVIEKKTSPQLQEDFFNQPCVSLAKSFLGQILVRKLPDGRELWGRIVETEAYLGGEDEASHSKGGKQTQRNAAMFMKPGTLYVYQIYGIYFCMNVSSQGEGAAVLLRSLEPLQGLDAMRELRRASRKAPTRLLKDWQLCNGPSKLCQAFGIDKTFDQRDLTQDAAIWMVPGQDPPGEQDVVATTRIGIGNRGEWAQKPLRFYLRGNRFVSVVDKKIEREMAARGHSPGS

SEQ ID NO: 217 - protein, 283 aa, Chrysochloris asiatica
MAAHSRPVSAVVAVLSLFRKVRHKRQRLSVAEKSRSPHDEARTPPCEGPCSRLPITPSPQRSIYFLSPQDHPVRLGPEFFDQPAVALARALLGQVLVRRLADCTELRGRIVETEAYLGPEDEAAHSRGGRQTARNRGMFMKPGTLYVYIIYGMYFCMNVSSQGDGACVLLRALEPLEGLESMRQFRSSLGKGAAGRALKDRQLCSGPSKLCQALAIDKSFDQQDLATDGALWLERGTPEAAVVAAARVGIGRAGQWVHKPLRFYVRGSPFVSVVDRTAEQTQA

SEQ ID NO: 218 - protein, 390 aa, Myotis davidii
MGQSGGCTFRVLYKHGRIGVILSYRATVRAPEGLEGTPSQVEGGGYGCIGDTSCRERQFSLAHSREPPEEHLLSSLPREGDRCGSQGRPRNILEGKLRTPRVSAHPSLLSRDPGIRIVQLSRKLGLKKQRLLGAEQHQCPPDGTPTPSPKEPRLGLPNALSPQRSIYFSSPRDPPARLGLDFFNQPAVPLARAFLGQVLVRRLDDGTELRGRIVETEAYLGPEDEAAHSRGGRQTPRNRGMFMKPGTLYVYFIYGMYFCMNVSSQGDGACVLLRALEPLGGLETMRQLRSTSRKGSTGRALKDRELCSGPSKLCQALAIDKSFDQRDLTTDKAVWLEHSPPGPREPAVVAAARVGIGNAGEWAQKPLRFYVQGSPWVSVVDRGAEQDTQV

SEQ ID NO: 219 - protein, 417 aa, Tupaia chinensis
MHPTHESAPVGKSYSVQSPVSHESAPVGKSHSAQSPVSHREALCTSWPCGSLQSLRSQVAAELTANPAVRLSQGLPQLSPRFSPAAFQPQEIILEANEALESYEKQKKPPPWGFGHPCTCAQCFQSLVLARAAERPNYHPGLAPLQLSQRRGQKKQRPAEAEQQWSPAAVAQSPSPKEPRLGAPAALGPQCSIYFSSPKGQSVRLGSEFFDQPAVPLARAFLGQVLVRQLADGTELRGRVVETEAYLGPEDEAAHSRGGRQTPRNRGMFMKPGTLYVYLIYGMYFCMNVSSRGDGACVLLRALEPLGGLEAMRQLRKSLRKSTASRALKDRELCSGPSKLCQALAIDKSFDQRDLAQDEAVWLEPGSPGPRGSAVVAAARVGIGNTGEWARKPLRFYVRGSPWVSVVDREAEKSTQA

SEQ ID NO: 220 - protein, 277 aa, Galeopterus variegatus
MRQKKQRLAVAEQQQSPPDMAQMPSPKEPRLGPPVTLGPQRSIYFSSPKSHPPRLGSEFFDQPAVLLAQAFLGQVLVRRLADGTELRGRIVETEAYLGPEDEAAHSRGGRQTPRNRSMFMKPGTLYVYIIYGMYFCMNVSSQGDGACVLLRALEPLGGLETMRQLRTSLRKGTSSRAVKDRELCSGPSKLCQALAIDKSFDQRDLAQDEALWLERSPLGPTRSAVVAAARVGIGQTGEWAQKPLRFYIRDSPWVSVVDREAEQENRTEQRACSDKNF

SEQ ID NO: 221 - protein, 267 aa, Fukomys damarensis
MGQKKKLAEADQQQSPTDTAWMPSSKKSCLRPSLALGSQRSIYFSQSPKDHSARLGSEFFGQPAVSLARALLGQVLVRRLGDGTELRGCIVETEAYLGPEDEAAHSRGGRQTPRNRSMFMKPGTLYVYLIYGMYFCMNVSSQGDGACVLLRALEPLGGLETMRQLRRTLRKGTISRALKDRELCSGPSKLCQALAIDKSFDQRDLAQDEAVWLEHGSLEPSASAVVAAARIGIGRAGEWAQKPLRFYIRGSPWVSVVDKVAEQDIQA

SEQ ID NO: 222 - protein, 353 aa, Nannospalax galili
MPSRSRSGASKGARGGARMKASVDTRARKPVTVTPPADTDQPPFPGRARQPGDAGAGFRVAGYREAHQKPASLSRKIGPKKQRLTEPEQQQIPPGTGWMPSPKERPPSTLGVQRSIYFSSPEGHPTRLGPEFFDQPAVTLARAFLGQVLVRRLTDGTELRGRIVETEAYLGPEDEAAHSRGGRQTPRNRGMFMKPGTLYVYIIYGMYFCLNVSSQGDGACVLLRALEPMEGLETMRQLRSTLRKSSVGRALKDRELCNGPSKLCQALAIDKSFDQRDLTQDEAVWLECGSHTGLGPSELAVVTAARVGIGYAGEWTQKPLRFYIQGSPWVSVTDRVAEQTACSDKLFNCLNTE

SEQ ID NO: 223 - protein, 325 aa, Schizosaccharomyces pombe; identical to SEQ ID NO: 79

SEQ ID NO: 224 - protein, 343 aa, Schizosaccharomyces octosporus
MISCISKFSIFMNNNLTAAPMKIDQKVIEHGKEQLKLSEDYDSARADDIEQSSFRKLRKHSNTVTFAESLKKFRYSTRSSKVEGLKQEENEGDDYNDDLLNGEKNGLRVSISQTKRKRARNATEVDKDYNKKGINRRNTRKDQKDALSQELPGVPDHIRENPYAILVGLNPGLTSSLRGHAYASPSNSFWRMMNKSGILEKGVEFTYENDQDLPAHGLGITNICARPSASGADLSKEEFREGAFILEEKVRRYRPRVGLFISGKGIWEEMYKATTGNKRLPKEFQFGWQDDTFGGSRVFVAISSSGRAAGYTSARKQELWNEFAKEVNMAREFDRKIRESPKS

SEQ ID NO: 225 - protein, 363 aa, Taphrina deformans
MSGAFDAFLYVPATPPATPSPTKKQPRATPAFLAPRLADLASPQLGRTDVVEQERKRKREPDVCLSSPGPESVRRRSPRLKSSLIASPPPSPDPSVSPSASASETLKKKKRRKAARPYADPALYAHLPQHLSDVIEEDLTLLMVGLNPGVMTAQTGHHFANPTNLFWPLLFSSGIITDPLKARDSELLPRRYGVGITNIVGRPTAEGGELSKDECVAGATRLMGLVRRYRPRAIALTGKGIWDAMFKAIHGRAIRKSDAFAFGWQQERIVDDHDGWSCPIFVTMGTSGRVAAYSPAYKREVFARLGDWVKGERHKMVKLSSEISDDVKAKVKESVVHGDDEVRDTETLVGVEASQGVKVEEQE

SEQ ID NO: 226 - protein, 329 aa, Bipolaris maydis
MPQTRSGKSRTQNDRVQQHVLSDGDGPEPNDTTATPPSASFKDQLSSYAYKEQEVTSNDVSASTNSDRPRKRPRTATIASAGSAQGSTRQPTKKRKAGQYALPSKYAHLSPLVDILEPNLICVFVGTNPGVQTATAGHAYAHPSNHFWKLLHASGLTDRRLKPEEDRSLPALYCMGNTNIVDRPSKNAAELSKEEMSAGTANLDAKFLKYKPEAVCIVGKGIWEAIWRYRYGKNPGKNEFKYGWQDEKHNMGKCPEDWEQELDVNGNPWNGAKVFVTTSTSGLAASLTPGEKETIWRPFGEWVQKRREERGFVPRPAETQSAVEETAQL

SEQ ID NO: 227 - protein, 322 aa, Leptosphaeria maculans
MPRTPSTKRDVVPDAFHDDSSSNALSSPPESPASPPPASSFRGQLSKFEFKEQEGRTSTNPIPKAAFASTSTTRSSKRSLSTTSTTPPSSQPKKQKRKPSKYAPPSKYAHLSPLTDILAPNLICVFVGTNPGIGTAVAGHAYAHPSNLFWKLLHSSGLTDRRLKPEEDRGLPALYCMGNTNIVERPSKDAAELSKEEMAAGTQRLEEKIRSFRPEAVCIVGKGIWEAVWRYRFGRGMRKGEFRYGWQDVEQNMGKVDGDGGWEGARVFVTTSTSGLAASLKPAEKEAIWRPFGEWVRKRREERGWVPQVASSDAVNQNNPQT

SEQ ID NO: 228 - protein, 318 aa, Claviceps purpurea
MEEHDDQAHRPPATFKGLLQLDAFTYHSSQSTSSSSSPRRNPVRAASTVLQVSRSAASKRPSTSRPQKRPAHSTTTTTTSSPSSSPTPKKRKTSRTRPPSGYAPPSQYAHLPLLPDALAPNLLILFIGLNPGISTALTGHAYAHPTNLFWKLLHTSGITPRRCHAHEDAHMPALYRLGLTNIVSRPTRNGSELSKAEMDNGVAILEEKAARWRPECVCVVGKSIWESIWRVRHGKGVRRHEFRYGWQDEGENMGVVEEGQGQEGEPWGGARVFVAPSTSGLAATLAPKEKERLWGELGSWVKGRRAAEGEDAEELMMS

SEQ ID NO: 229 - protein, 319 aa, Fusarium fujikuroi
MTRSKAAQEATIQDPVGDDGAEQERDISSSPPPPATFKGRLQMSDFMFKSNESSSGQTSPIRRSPRFTTPTISTSVSSASAAKSKRTIERDAEDKEKDIKPKKKRARQASGYAPPSTYAHLNGLPDAIASNLLVLFIGLNPGIQTARTGHAYAHPSNLFWKLLYSSGLTPRLCSPTEDRQLPELYSMGFTNIVARPSRNGSELSKQEMDEGVEILHEKCRKYRPESVCVVGKSIWESIWRVRHGKPVGKAFKYGWQDESENMGVIEGEWEGSKVFVSSSTSGLAATLSPAEKERIWAEIGTWAQKRRAERELEAKEESK

SEQ ID NO: 230 - protein, 327 aa, Podospora anserina
MSETSSPQEEATDNLPTPTFAGRLKLSEFIFTPEQKKSMPLQQPLRKSPRLLTSTSSSSTPLLQPSPSIPSPLKRSPSEPPSSISSPSKRKRPKPLPTPPGPLPLLPDAIAPNLILLFVGLNPGLLTSSTGHAYAHPTNLFWRLLHSSGITPRLCAPQEDRLLPSLFSLGLTNIVPRPTRNGAELSKKEMDAGVAVLEEKIRKFKPEVVCIVGKSIWESVWRVRHGRGIKKEEFRYGWQERGEDMGKVEGGGEWNGARVFVACSTSGLAATLKPREKEEIFGELGEWVVKRRREREEEKGVGSGTDGGEDGGEGIGQVDDAEVKQES

SEQ ID NO: 231 - protein, 382 aa, Sordaria macrospora
MASPEATVHDEERTPPPPTFAGRLKLEDFKFDGNGSTSTSPSPGGIRRSTRLSSTKSTSITTNATSTTSSSPRKTTQTSHTQTTTSTITTTTQTLGTPSSSSKRKLTTSTSSNISTSLTPTRHSSKRLKALPAPKKTYDNIPQSLPDCLAPNLTLLFIGLNPGLSTAIQQHAYAHPTNLFWRLLHSSGITPVLCSPSEDRTLPERFALGLTNIVGRPTRNGGELTKKEMDDGVEILEKKVRECRPEAVAVVGKGIWESIYRVRHGGKGLKGKGNGGLPKDWKYGWQDESENMGVVEAGEDKEDGENDEKGWKGARVFVATSTSGLAATVGRAEKERIWRELGEWVERRREERKAEKEKGKEGVKGMGERRVEEEKEENENDK

SEQ ID NO: 232 - protein, 314 aa, Sclerotinia sclerotiorum
MDKQQNSKYFKREEVEIHTTTNLSAPSFGSRLNLSSFTYSADSPSHSTRQSSRRLSSNPSTPQLSPSPLKRKIDIESSVSANASTSPVKKSRTRRSTGYAPPSLYAHLPFLPDVVAPNLLCLFVGLNPGLETARVGHAYAHPSNRFWKTLYSSGCTTRLLKAEDDVRLPELYSLGNTNIVERPTRNGGELSKKEMDNGVSVLEEKIRMYRPEVVALVGKSIWESVWRVKKGKAMMKDQFKYGWQSEEENMGIVSGAESWMGARIFVTSSTSGLAASLSPAEKEKIWRELGSWIEQRRKEKDGIHRVKEELEDSG

SEQ ID NO: 233 - protein, 284 aa, Fusarium oxysporum
MTRSKAAQEATIQDPVGDDGVKEEQDISSSPPQPATFKGRLQMSDFIFKSNESSNGQTSPIRRSPRFTTPITSTSASSASAAKTKRTKERDAEDIEKEIKPKKKRARQASGYAPPSTYAHLNGLPDAIASNLLVLFIGLNPGIQTARTGHAYAHPSNLFWKLLYSSGLTPRLCSPTEDRQLPELYSMGFTNIVARPSRNGSELSKQEMDEGVEILHEKCRKYRPESVCVVGKSIWESIWRVRHGKPVGKAFKYGWQDESENMGVIEGEWEGSKVNWNMGSETES

SEQ ID NO: 234 - protein, 359 aa, Fusarium graminearum
MTLRQGLKQGYVWLWRLTEIVHKKWTSKQNSSGIISHIALDDTIIQSTAPMEENVADEEINDGSDIPSSPPQPATFKGRLQMSDFMFQSAEPTAKGETSPIRRSPRLNPSTLSATVAPTPISTDKRTKKRQAEDKENGVTPKKKRARPSSGYAPPSTYAHLPGLPDAIADNLLVLFIGLNPGIQTARTGHAYAHPSNLFWKLLFSSGLTPRLCSPTEDRKLPEMYSMGFTNIVARPSRNGSELSKQEMDEGVEILHEKCRKYRPESVCVVGKSIWESIWRVRHGKPVGKAFKYGWQDESENMGVIEGEWEGAKVFVSSSTSGLAATLSPAEKERIWAEIGTWAKKRRVERELEKEGNGS

SEQ ID NO: 235 - protein, 345 aa, Exophiala dermatitidis
MGNTTGLRAAQELDEDNKLSAAVQATFKAHLKHFEYTADTTGKTSPSPQRRSPRLAGWRSSTPSSPVSNVSSSRKRSRVSPSTTPKAIKTEDEQKDGLSVTEGTGSTGSEETESVSTPRLKKRRSTTKERSARDPYSPANKLVDSLRPGLILVFVGLNPGLMTAATGHAYAHPSNRFWQLVHDSGITPKKHLPSETRDLMDLYQIGNTNICERPTRSGDGLSKLELEEGAMILDRKIAKYRPEAVAIVGKGIWEAIWMAKKGEKKFKDNFHWGWQDEELQLGRTIDDEGAVVWEGAKTFVTTSTSGLAATLTPAEKLAIWKPLGEWVTERRERVKDEESSSDQVG

SEQ ID NO: 236 - protein, 337 aa, Orbilia oligospora
MASNRVLRSTSSRSEISTTGNAVVEEKSTSFKGTINKFSMSTSESVASGTTEESKESKETTRTSTKRKYTDVLSYKAGAAPGGPKKKSSSYAPPSKYAHLKGVPDQLGENMYCMLIGLNPGIATSQAGHCYANPSNLFWRMLHQGGLTTRQCKPQEDEILPAEFNLGTTNIVGRPTASQAELSLEEMDEGVADLERKCRRYRPESVCLIGKAIWESVFRAKHGRKMTKTEFKFGWQHEKENMGVDKKNGYPGARVYVVVSTSGLAAGYSLDYKLQLWKELGSWINERRAERLEESASEGKDENVKKLKVEHVTEDLEPAASAADDLEASGSSSIKAE

SEQ ID NO: 237 - protein, 309 aa, Phaeosphaeria nodorum
MTRLTKAGAENTISEITEDSSAATTTSFKDQLSKFQYSDGNAPLNIGTAESGRPQRTAKRARPAEPDVVTTASTPSPRPKKKRASSKYADPSKYAHLSPLVDILEPNLICVFVGTNPGVQTATAGHAYAHPSNHFWKLLYSSGLTDRRLKPEEDRSLPALYCMGNTNIVERPSKDAAELSKEEMAAGTASLDAKFVKYKPEAVCIVGKGIWESIWRYRYGKNMGKADFKYGWQDEKHNMGKSMDGEETDANGEVWNGARVFVTTSTSGLAASLKPAEKEAIWKPFGEWVQRRREERGFIPRSSDVPEPS

SEQ ID NO: 238 - protein, 313 aa, Verticillium dahliae
MGTENEGIKSEEVTTDMLEAKPASFNGRLQNFIHVPSSTVSPLRRSVRVAATLGQTGNLRPAPKLQASPSPSPSRPTKRKTSPSEGAKRKRSTPRYAPPSTYAHLPPLPDAITPNLLILFIGLNPGIQTASTGHAYAHPSNLFWKLLHHSGITSRLLPASEDRTLPERYACGFTNIVSRPSRNGAELRNAELDAGVAVLEAKIAKWRPEVACIVGKGIWEAVFRVRKGRGMKKGEFEYGWQEGENMGVVRDGEEGGPWEGARVFVATSTSGLAATLGPREKEVIWGELGAWCTQRRAERGMLTEVKEEMASSF

SEQ ID NO: 239 - protein, 313 aa, Trichoderma virens
MEQGEELPNTAEGVESGKSATFEGRLQLKEFMYTSQQSVRRSPRFAAAPESPSSSSATSVTVPSSSNKRRQSAAPSSSSSSPQKKKRTRPSAGYAPPSTYAHLPELPDAVAPNLLVFFIGLNPGVETARKGHAYAHPSNLFWKLLYSSGVTPRPCRPEEDRQMPQLYSLGLTNIVSRPSRNGAELSKQEMDDGVAILEDKARKWRPESMCVVGKSIWESIWRVRHGSPVGKAFKYGWQDESENMGVIEGEWAGARVFVATSTSGLAASMSLAEKQAVWNQLGSWVKTRRAEREAQEEKEVSQEKTVEETDSAS

SEQ ID NO: 240 - protein, 380 aa, Colletotrichum graminicola
MESPFFDREPRPQAASFRGRLQLQDYMFSAATTSAPPGGGAAGTPATAASPGLPSPSPTPLRRSPRKSTALGPVPSPNRVSKHRNASGRNNSNSTAAATAIKSAASTPEPSQKTPPPPASGVLSPKPEPPDSDSIDLALVPANITPPAGNAKPKRRRKAAGYAPPSTYAHLPHLTDILAPGLLILFVGLNPGLRTAALGHAYAHPSNLFWKLLHSSGITPRLCAPTEDRDLPRLYGLGNTNIVARPSRNGAELSKAEMDEGVDVLEDKVRGCRPEVVCIVGKGIWESIWRVRRGRGIRKEEFRYGWQDEREDMGVVVAAKGGDAAADGASPTAWAGARVFVATSTSGLAATLRLAEKERIWRELGEWCERRRAERGAEAS

SEQ ID NO: 241 - protein, 340 aa, Thermothielavioides terrestris
MPPSETVEDGCPQPTFQGRLKLESFMFNGGATAGGLRRSPRLSVTPSATASPPAPSPIPTSRSPAKRKALSLAGDGVDSSPSASSSTPSSPSSRLKKKRARQRSGYAPPSTYAHLPLLPDAIAPNLLVLFVGLNPGIETARTGHAYAHPTNLFWRLLYSSGVTPRLCSPTEDRQMPALYSLGLTNIVARPSRNGAELSKAEMDAGVEILEEKVRRWRPEVVCVVGKSIWESLWRVRHGRAIKADEFSYGWQDERENLGLVQGGVQKEEEKETGVDYSADWKGARIFVATSTSGLAATLRPKEKEEIWKKLGAWVEERRAQRAQAAASATEPISQSNLNEG

SEQ ID NO: 242 - protein, 332 aa, Macrophomina phaseolina
MVRTRASKAQLEELSKAANGSTSEQAPPADDTRSEPDAIETLHDQRDITRPASTFSGHLQRFQYSEAPSISPGKPASPEANVSRPALKRTRTTQALASATNGAASPSPAKKRRASSKYAPPSKYSHLKPLTDILEPNLICVFVGFNPGVRTATAGHAYAHPSNLFWKLLHSSGCTDRLCRPEEDVDLPRLYSMGNTNLVSRPSKNEAELSKTEMAAGTPILEAKIREYKPEAVCIVGKGIWEAIWRYRYGRNPSKADFKYGWQDEKENMGKPELGSAADGRENVWQGARVFVATATSGLAASTKPAEKEAIWRPFGQWVKQRREERSAASSR

SEQ ID NO: 243 - protein, 317 aa, Tuber melanosporum
MPPIRREKTNSTATKAFQERLESFAFSSVSTRTRAANRAASKSNTPPATDQGPEEAPSANLDSTSKMVATRTTVRAVTKSRAKPASRRGKQKSSYAPPEKYAHLGGVQDAFAPNLLSVFIGLNPGITTATVGHAYSAPSNHFWKLLHSSGLTPDRVCPSTEDIHLPRKYSLGNTNLVARATLNQAELSREEMDDRVELTEDKIRRWKPESVCIVGKGIWESIYRAKHNGAKIPKGKFVWGWQSDEDRFGVDVEEGYPGARVFVVPSTSGLVAGYSMQFKKDIWKVLGDWVQMRRKERGETAPRTDNLVEGESSGVVE

SEQ ID NO: 244 - protein, 425 aa, Botrytis cinerea
MGKQLNSKYFKTEETEADAANNITAPSFQGKLDLSSFTYSPNPPSRSRRQSPQINSRNLLLEASASKAALSSLNQDSYTEAPNVTTDSQSEFKRNRLEAWNCKLSEQATHEHGNHGFGMTYNEAELSSPEQHDRLIKIELRGDCTPSPMTLPMPTSVQKRQSSTMCPSEVPKHANASPSPSKRRLEPLSASPASNPSPAKKRRSRAGGGYKPPSHYAHLSFLPDVISSDLLCLFVGLNPGLLTAQVGHAYAHPSNRFWKILYSSGCTTRLLKAEDDVKLPELYSLGNTNIVERPTRNGGELSKKEMDEGVSSLEEKIRIYRPEAVALVGKGIWESVWRVKKGKAMAKDEFRYGWQSEEENLGVVEGEDSWGGARLFVASSTSGLAASLSPAEKESIWRELGSWIEQRRKERDGLNGVKEEVEDCG

SEQ ID NO: 245 - protein, 297 aa, Pneumocystis jirovecii
MSEEREKLEKNEQFKGNKTNFEKIIEEFRYTHILPKRSQDDNVDQCYPAKRSQLQRQNIKKSQTDADQNTDPSIQMVHHNKRKRKTNRSYVPPEHYAHLPAGVPDVLGKNLIVMFIGLNPGIATVKAGHAFAGPTNLFWKLLHSSQIVCTETRLRPEDDVTLQKWDVGITNLVSRPTAGSNELSREEMIENVPILEKKVSTFCPLSVCIVGKGIYEAIYRYKTGKPLKKTFEWGWQPERMGTSENYEGALVYVVPSTSGRAATYSKEMKEKCWNIFGQWVAKKREERSKSKDIFNES

SEQ ID NO: 246 - protein, 344 aa, Capronia epimyces
MGDLTVIRDGDGDGDTHRLEEDTVSSEVTLPAADQAAFKARLKQFEYSPKTDISPQRRSSRFATWRSSTPCSPVSSASPSRKRRRLSSQPRTDGDESKERDEELARGSAGSKDSTLTPKSKSKKKRSTTKERSARDPYSPTNKLVDSLRPGLILVFVGLNPGLMTAATGHAYAHPSNRFWHIVHASGITPQKHDPSETRDLMDLYQIGNTNICARPTRSGDGLSKAELEEGALILDQKIAQCQPEAVAIVGKGIWEAIWMVKKGQKKFKDPDFHWGWQDEEMQLGRRVDESGRVIWAGAKTFVATSTSGLAATLTPAEKLAIWKPLGDWVTRRREEWRAEVLQQ

SEQ ID NO: 247 - protein, 329 aa, Bipolaris sorokiniana
MPQTRLGKSRNQNDKVPQHVLSDGDGPEPNDIPATPPSAPFKDQLSNYAYKEQDVTSNEVSTSTNSNRPRKRPRTATIAAVGSARGSTQQPTKKRKAGQYALPSKYAHLSPLVDILEPNLICVFVGTNPGVQTATAGHAYAHPSNHFWKLLHASGLTNRRLKPEEDRSLPGLFCMGNTNIVDRPSKNAAELSKEEMSAGTASLDAKFLKYKPEAVCIVGKGIWEAIWRYRYGKNPGKNEFKYGWQDEKHNMGKCPEDGEQELDANGNPWKGTKVFVTTSTSGLAASLTPAEKEAIWRPFGEWVQKRREERGFVPRLVEAQSAVEETAQL

SEQ ID NO: 248 - protein, 340 aa, Trichoderma reesei
IQFRQDLSLHGFTHDSAPASMGSREDVAIPDENVPTVAPTPATFEGRLQLNKFMYNGQQPVRRSPRFAAASESPSPSSAISVTASSTTRSASSASSSSVSKRRTPSSSSPSSPAKKKRTKPSSGYAPPSTYAHLPELPDAVAPNLLVFFIGLNPGIETARSGHAYAHPSNLFWKLLYSSGVTPRPCHFSEDRRMPELYSLGLTNIVARPSRNGAELSKQEMDDGVSILEDKARKWRPESMCVVGKSIWESIWRVRHGAPVGKAFKYGWQDESENMGVIAGEWPGARVFVATSTSGLAASMSLAEKQAVWNQLGSWVKTRRAEREAEEERAQSVDEGASAS

SEQ ID NO: 249 - protein, 317 aa, Ophiostoma piceae
MDEDSGTAPTRPGKLRLAQFMYNPGTSDIAGEPAPPTRNFHSRSLAERQPASAKRKLAEDADAQSEEPSAASSSSPSPKRLSKRTAVRNRSLAASKYAPPSTYAHLALLPDAIAPNLLVLFVGLNPGVETARSGHAYAHPSNLFWKLMYSSGVLPEQCAPDEDRTLPARFQLGLTNIVSRPSRNGGELKAAELDDGVAILEDKARRWRPEVMCMVGKGIWDSIVRVRARAGRPKPVFKYGWQSESENLGAVPVSDEDPVEEGVRMDPDWKGARVFVASSTSGLAASLRPAEKEAIWRQLGEWVEIRRKEIVEAADER

SEQ ID NO: 250 - protein, 217 aa, Trichoderma atroviride
SSSSSPQKKKRNRQKSGYAPPSTYAHLPELPDAVAPNLLVFFIGLNPGIETARTGHAYAHPSNLFWKLLFSSGVTPVPCRADEDRQMPERFSLGLTNIVARPSRNGAELSKQEMDDGVALLEDKARKWRPESMCVVGKSIWESIWRVRHGSPVGKAFKYGWQDESENMGIIKGEWAGAKVFVATSTSGLAASMSPAEKQAVWNQLGSWVKTRRAERE

SEQ ID NO: 251 - protein, 311 aa, Cordyceps militaris
MSSAEPAVEPGAGDNPSPPPPPSSFHGRLQLQDFMYQSADPPAPRRSARNANPTAAAAPIRSTPSPRKRAGAPSPAASGVSKPAKKQQQQQKKKKPSSGYAPPSTYAHLPLLPDAICADLLVLFVGLNPGLQTARTGHAYAHPTNTFWKLLHSSGITPRPCAATEDRQMPALYGLGLTNIVARPSRNGAELRRHELDDGVALLEDKARTWRPEAVCVVGKSIWESIWRVRHAGAPVGARFRYGWQDTAENMGVVDGRWPGARVFVASSTSGLAATLSPAQKQEIWNELGAWVKMRRAEREVAAEREGVSGA

SEQ ID NO: 252 - protein, 353 aa, Thermothelomyces thermophilus
MGADITEDTRPPPTFQGRLQLESFMFKAGFATAGLRRSLRLSSASSSSAAALPVPPPRRASRSPSKRKADPPDEDDLKEEDTSSPSTPAATSTTSITSTISATATATATVTVTRSPSRNNRSKRARVPSSYAPPSAYAHLPGLPDALAPNLLVLFVGLNPGIETARTGHAYAHPTNLFWRLLHSSGVTPRLCAPAEDRQLPARYALGLTNIVARPSRNGAELSRAEMDAGVAVLEAKIRRWRPEAVCLVGKSIWESVWRVRHGRPIRPAEFRYGWQDERENMGQEEEEEEEEEEKEEGVVYDPDWKGARVFVATSTSGLAATLKPKEKEEIWKELGDWVVKRRAERAAAGDSV

SEQ ID NO: 253 - protein, 214 aa, Pseudocercospora fijiensis
SASASPAKKRRQSGKYAPPSKYAHLTPLADILQPNLICVFVGFNPGVTTAQTGHAYAHPSNLFWKLLHSSGCTDERLVPEQDIDLPRLYGMGNTNIVARPSKDAAELSKAESAAGTPLLEEKVRKYRPEAVCVVGKGIWESIWRWRYKREIQKHEFRYGWQDEKERMGKTDDWPGAVVFVATATSGLAANLRPHEKEAIWKPFGEWVKQRRQER

SEQ ID NO: 254 - protein, 295 aa, Metarhizium acridum
MTDDQGRKPATFKGRLQLDAFKYTTTEPMRRNPPRAASTPIQTRAQDESPTPSLSPRKRTSSSPPKSSPEKKKKKRTRQAGYAPPSTYAHLPLLPDAIAHNLLVLFVGLNPGIRTAMTGHAYNHPSNLFWKLMYSSGVTPRRCYAEEDREMPALYSLGLTNIVARPTRNGSELSKAEMDDGVALLEQKARTYRPESMCVVGKSIWESIWRVRHGSNVGKQFRYGWQDETENMGVVEGSWGGARVFVASSTSGLAATLTPAEKERIWGELGAWVKMRRAEREAAESKEEEEEEAER

SEQ ID NO: 255 - protein, 240 aa, Eutypa lata
MQTSRSTKRPRARKGEPSSNYVPPSAYAHLPLLPDAIAPDLLILFIGLNPGIETARTGHAYAHPSNLFWKLLHSSGVTPVLCAAAEDREMPTRYDLGLTNIVERPSRSGAELSKAEMDDGVAALEAKCARWRPEVACVVGKGIWESVFRVKKGRAMTKGEFQYGWQDADGMRMGVVEDEEAGSEGGSGKWEGSRVFVASSTSGLAATLKPKEKERIWKELGDWCVLRRTEREEDGDVLRS

SEQ ID NO: 256 - protein, 320 aa, Fusarium pseudograminearum
MTKGKIVQEARIQEDVADEEINDGYDVPSSPPQPATFKGRLQMSDFMFKSTEPTPKGETSPIRRSSRLNPSTSSATIAPAPVTTAKRTKKRQAEDNENDVTPTKKRARPSSGYAPPSTYAHLPGLPDAIADNLLVLFIGLNPGIQTARTGHAYAHPSNLFWKLLFSSGLTPRLCSPTEDRQLPEMYSMGFTNIVARPSRNGSELSKQEMDEGVEILHEKCRKYRPESVCVVGKSIWESIWRVRHGKPVGKAFKYGWQDESENMGVIEGEWEGSKVFVSSSTSGLAATLSPAEKERIWAEIGTWAKKRRVERELEKEGNSS

SEQ ID NO: 257 - protein, 329 aa, Bipolaris oryzae
MPQTRSGKLRNQNDKVPQHVLSDGDSPEPDDAPAAPPSASFKDRLSSYAYEEQDATSTEISVSTNFDRPTKRPRTATIASVGSTQGSTRQLTKKRKAGQYALPSKYAHLSPLVDILEPNLICVFVGTNPGVQTATAGHAYAHPSNHFWKLLHASGLTNRRLKPEEDRSLPALFCMGNTNIVDRPSKNAAELSKEEMSAGTANLDAKFLKYKPEAVCIVGKGIWEAIWRYRYGKNPGKNEFKYGWQDEKNNMGKCPEDVEQELDASGNPWKGARVFVTTSTSGLAASLTPAEKEAIWRPFGEWVQKRREERGFVPRLVEAQSAIEETAQL

SEQ ID NO: 258 - protein, 290 aa, Spizellomyces punctatus
MSMNTEDDNNNNKTIHSEPGFKGLIAGFAYTGPAARASRLKLPVGANVQVDEQYKASSGSARILDKVTSDATKRRTKRSATVLDTSSKRIRAAQTITPLKEVPDYLEKDLDVVFCGFNPGIQSSTRGHHYAGSNNHFWTCLSESGLVGSTVVTYKDDARCPADFSIGFTNIVSRPTRGSSDLSMKEMSAGADPLYAKITTFRPKVCCFVGKGVYEAFSGKKKFELGLQAEKVGATALFVVPSTSGRVSAYSKEDKLLLFKELKRVLDEITASKSLFTEDAILHQPENDLS

SEQ ID NO: 259 - protein, 274 aa, Fusarium verticillioides
MEVTRRSRRLAQVLHTSDNTPSDAEASIPRRAKRARPGSVLSSSLERHGRTRKPRTSQARLKKYAHLPLLRDTLVPNLICVFVGMNPGIQTATAGHAYAHPSNHFWRLLHTSGCTDRLCLPEEDGDLPHLYAMGNTNLVGRPSRTTSELSKQEMAEGTPVLEDKIRIYKPEAVCFVGKGIWEAVWRWRYGCDPTKEEFKYGWQDESENIGRSKDGIQGRDNRGRVWDGAKVFVATSTSGLAANLSMEEKKAIWSDLGVWVKRSREERKQNNSDT

SEQ ID NO: 260 - protein, 282 aa, Nectria haematococca
MAKRKATKEADVEEPIVEQVQDEEQEALSSPPKPATFKGRLQLNDFAFKSDQPDSTSGDRRRSPRFASSASASSTSTAASKRINNDDQEDDGAKPQRKKRARAPAGYAPPSTYAHLPGLPDAIGDNLLVLFIGLNPGIQTARTGHAYAHPSNLFWKLLFSSGVTPRPCKATEDRQMPELYSLGLTNIVARPSRNGSELSKQEMDEGVEILHEKCRKYRPESVCVVGKSIWESIWRVRHGKPVGKAFKYGWQDETENMGVIKGEWAGAKVGKGTYLGTTWIMG

SEQ ID NO: 261 - protein, 315 aa, Beauveria bassiana
MSSADPDLEAGPGESPSPPPQLSSFHGRLQLQDFMYQSADAPATPRRSPRHQAASASASPSIRATPTVRSRARDVASPSSATSSSASGITKPKPKRKKRPSPGYAPPSTYAHLPLLPDAVCANLLVFFVGLNPGLQTARTGHAYAHPTNTFWKLLHSSGITPRACTADEDRQMPELYSLGLTNIVARPSRNGAELSRQEMDEGVALLEEKARTWRPESMCIVGKSIWESIWRVRHGGKAVGASFRYGWQDEAENMGVVQGEWEGARVFVASSTSGLAATLSPAQKQEIWNELGAWVKMRRAERELAAEREAASNG

SEQ ID NO: 262 - protein, 324 aa, Chaetomium thermophilum var. thermophilum
MASETTEETRPPPSFKGRLQLESFMYNGSGLRRSPRLSGALSYSAPPTPSAAQPNLSSKRKEPPSQNSQDGASDGDGNGTSSSSSASNSQAKRKRVRQPSSYAPPSTYAHLPPLPDSLGPNLLVLFVGLNPGIETARSGHAYAHPTNLFWRLLYSSGVTPRLCSPTEDRQMPALYSLGLTNIVSRPSRNGAELSKQEMDAGVDILEKKTRIWRPEVVCIVGKSIWESIWRVKHGKAIKPAEFRYGWQDETENMGVVGPQGQKEEEKEEGVEYSPDWKGARVFVATSTSGLAATLKPKEKEAIWKELGDWVVKRRAERVAAADRS

SEQ ID NO: 263 - protein, 341 aa, Phaeoacremonium minimum
MAPAAAANESPPSPKATFEGRLKLQDFIFKGASTEASSGAAMLRRSPRISTPKSTILGSPTPSPTPQRTASITGSARKRKAATAPPSVSATPSSPSSLNKLSSPSPSKKRKRPKASGYAPPSTYAHLPLLPDAIAPNLLVLFVGLNPGIQTAVQGHAYAHPSNLFWKLMFSSGVLPEPVHYSEDRTLPARFRLGLTNIVARPSRNGAELSKAEMDEGVAVLEAKARRWRPEAVCIVGKSIWESVWRVRHGRAVGKHEFRYGWQDAGENMGRLGAAGVSEEEKEDGVEYAPDWKGARVFVASSTSGLAATLSPAEKEKIWRELGSWVEERRAELQKTSSADA

SEQ ID NO: 264 - protein, 306 aa, Pneumocystis murina
MKVEDENCFEELKESKEGVEYLDGNRKLKEILEKCKYVDKSAKNMSRNVENSSKLMKDGLSFRKLLEKRGFSRNNLLSSEVISNESINSHDKRKQKPKRSYIPPEYYSHLPSGVPDVLRENLIVMFIGLNPGIATVKAGHAFAGPTNLFWKLLHSSRIVCTETRLRPEDDVKLGKWDVGITNLVSRPTASSNELSKEEMIENVPILEKKITAFYPLSVCIVGKGIYEAIYKYKTGKSLSKPFEWGWQPQRVGASENYEGALVYVVPSTSGRAASYSRKMKEHYWNILGEWVALKRKERQNLDNIFK

SEQ ID NO: 265 - protein, 263 aa, Cyphellophora europaea
MTRANVASKSSTPISSVTASSRKRASNGGESTPKKKRSTAKERSENDPHNPENNLVDSLRPGLILVFIGLNPGLKTAETGHAYAHPSNRFWHLLHESGVTPRKHLPSETHDLPDLYSIGNTNICARPTRDGSGLRKEELAEGAGILEEKIREFKPQAVCIVGKQIWEALWLARTGKKLKKDLFKWGWQDEDNWLGRIVDDDEHVLWPGARTFVSTSTSGLSASMKPHEKLEVWLPLGEWFKERTERGEQTGVEQPFKSGEHSS

SEQ ID NO: 266 - protein, 397 aa, Pyronema omphalodes
MPKRKEPTSDPSSTATALEAAEEPAISTPTFNGALSKFAFSSPASPVSPSSPSSTPSRPSRTKSALAEIKPTSVRRSPRNPTVNPSPFESPMKLEIKEEDSTTDGSAKKKRKRPASKYAPPSTYSHLSGIPDVLAPDLLCLFVGTNPGLLTASTGHAYASPSNLFWKLLHQSGLTPDCRRPPTDDLKLPELYSLGNTNLVPRPTRDQAELSVQEMENCVPMLEEKVRKWKPEAVAIVGKGIWERCFKVKMGKKLGKEFKFGWQEERMGVEDGWEGANVFVAVSTSGLVAGYKWDEKLRIMKELGDWVNQRRQERGETAPRGLPEEVVNEAAERREREHREALGEMEVKKEKILSAEIGEIPVKDEPEDEGGLEIGGELEDDSDSMMETVKDEPKIAE

SEQ ID NO: 267 - protein, 349 aa, Endocarpon pusillum
MDIKIEEHTEQNLKTTRANDSESVPRRSFRDHVLRFGYSTSSPTKQLSQDNPVLPPAQPTSPVLKRKRSQALPRKVASHLDPAESSIQEAKSATPKRKSTPRSRKASSASASPASPGTPIISKLHDTLRPNLTLVLIGLNPGIMTANTGHPYSHPSNGFWKILYSSGITPIQHRPQDHRLLPDLYGIGNTNICARPSRLGSELTKAELAEGAKILDDKIATYRPEAACISGKGVWEAIWIYKTGRKKMPKDGEGAFQYGWQDDRLRLGRTVDAKSGEVVWEGAMTFVAPSTSGLNAGMRPAEKEEAWRPIGEWMRKKREQRGMKLETVKTEQKMTNGVAMATKDLDPFV

SEQ ID NO: 268 - protein, 330 aa, Pestalotiopsis fici
MAKAKLGEPTPALESTPSFEGRLRLNQFMYTSSDNEATSLRRSSRLVTPISSTISQARSPRASSKTSSPAPRPIKRKHGGPGEGAGESSNPDTSSQTSTPSPKKKRSNRPKSSYAPPSTYAHLPLLPDVLGPDLLILFVGLNPGIQTARSGHAYAHPSNLFWKLLFSSGITPVPCRAEEDGTLPERFALGNTNIVARPSRNGAELSRAEMDEGVAVLEDKIRKWRPEVVCIVGKSIWESIWRVRKGRAITKAEFRYGWQDETEDMGIPGQSNGKDVETSDLKGARVFVATSTSGLAASLRPEEKERIWKELGDWCKARRRERQAEDLTNE

SEQ ID NO: 269 - protein, 323 aa, Dactylellina haptotyla
MSSKRTLRSASRSNSETPATGNAVVEEKTTTFKGSIDKFGLETSESSKISSTVVEETEKIKGTTETKDDKKVTAKRKITDVLSYKPGASPVPKKKSSSYAPPSKYAHLKEVPDQLGDGMYCMFIGLNPGIATSQAGHCYANPSNFFWRMMHQGGLTSRLCKPQEDEILPSEFGLGTTNIVSRPTANQAELSLDEMDDGVALLEQKCRTYKPESVCLVGKAIWESVFRAKHGRKMTKTEFKFGWQNEKENMGVDKKNGYPGARIYVVVSTSGLAATYPMEYKLKLWKDLGKWVNERRADKEEGGDSAKTKTEGEASTAAGSADD

SEQ ID NO: 270 - protein, 292 aa, Baudoinia panamericana
MQISTRKLRSTIQRFQYDSPSTIPSPTPRVTTGTSPSQSIRKRRAADSNSNARQDSPSPSKRRRQSSKYAPPSKYAHLPKLTDILQPNLICIFVGTNPGIQTATAGHAYAHPSNLFWKLLRSSGCTDVRLPPEHDVHLPEWYGMGNTNIVERPSKDAAELSKAEMAAGTPVLEEKVRRYRPEAVCIVGKGIWEAVWRWRYKRELKKEEFRWGWQEDGERMGKGEGWEGARVFVTSSTSGSAASLRPAEKEAIWAPFGEWVKMRRKERFGTEGRIDRVQYAMEHEDDEAVEGD

SEQ ID NO: 271 - protein, 300 aa, Metarhizium robertsii
MTDDRGRKPATFQGRLQLDAFKYTTAEPTRRNPPRAASTPFQTKAQDESQTPSPSPRKRTSSSPPKSSPAKKKRARQATGYAPPSTYAHLPLLPDAIAHNLLVLFVGLNPGIRTAMTGHAYNHPSNLFWKLMYSSGVTPRRCYAEEDRDMPALYSLGLTNIVARPTRNGSELSKAEMDDGVALLEQKARTYRPESMCVVGKSIWESIWRVRHGSNVGKQFRYGWQDEEENMGAVEGSWAGARVFVASSTSGLAATLAPAEKERIWGELGAWVKMRRAEREAAESKEEEEEEEEEPEGCGD

SEQ ID NO: 272 - protein, 329 aa, Schizosaccharomyces cryophilus
MNNVSTAKAISMKVDEYAVKDEKEISTSNEEYKFKEGSGKELSDFKNLSKNQKTSTFAESLKKFQYPLESPRFKHEESVDVDRLGADFPNDEKNELLDSTLQVKRKRGQSALELELEKGSSIKRTTRKTTNRIQKGSLPENLPGVPDHILENPYAILVGLNPGLTSSLRGHAYASPSNSFWKMLNKSGILEEGAEFTYENDQDLPVHGLGITNICARPSASGADLSKEEFREGAFILEEKVHRFRPKVGLFISGKGIWEEMYKATTGNKRLPKDFRFGWQNETFGGARVFVAISSSGRAAGYSNAQKQELWNLFAKEVNLAREFDRRNQ

SEQ ID NO: 273 - protein, 211 aa, Zymoseptoria tritici
SSPSPSKRKRPSSRYAPPEKYAHLAPLTDILTPNLICVFVGFNPGVRTATSGHAYAHPSNLFWKLLHSSGCTDRRLEPREDVDLPRLYRMGNTNIVARPSRDAAELSKAESAAGTPILEEKIRKFRPEAVCIVGKGIWESIWRWRYGRNIRKDEFRYGWQDEREKMGKTEDWEGAWVFVATATSGLAASLRPHEKEAIWKPFGEWVKSRRE

SEQ ID NO: 274 - protein, 320 aa, Verticillium alfalfae
MGAEDEGIKSEELTEDILEAKPASFHGRLQNFIHVPSSTDSPPRRSVRVAATLGQAGNLRPEPRLRASPSPSPSRQTKRKASPSEGIKRKRSTPRYAPPSTYAHLPPLPDAIAPNLLILFIGLNPGIQTASTGHAYAHPSNLFWKLLYHSGITSRLLPASEDRTLPERYACGFTNIVSRPSRNGAELRNAELDAGVAVLEAKIAKWRPEAACIVGKGIWEAVFRVRKGRGMKKGKFEYGWQEGENMGVVRDGEEGGPWEGARVFVATSTSGLAATLGPREKEVIWGELGAWCTQRRAERGMLTEVKEEEAKSDGIELLDP

SEQ ID NO: 275 - protein, 378 aa, Colletotrichum sublineola
MESPFFDQEPKSQVASFQGRLQLQNYMFNAATASSLPGGGAAGTPATSTSPGLPSPSPTSLRRSPRKPTPLGPLPSPNRVTKYRNAAGRNNNSNNNNDTTAITAAATKLTTLTSESSQKTPSLPAPGALSPKIESPGLDSIDLALVPANTTPPAGNAKTKRRRKTAGYAPPSTYAHLPPLTDILAPGLLVLFVGLNPGLRTAALGHAYAHPSNLFWKLLHSSGITPRLCAPTEDRDLPRLYGLGNTNIVARPSRNGAELSKAEMDEGVEVLEDKVRECRPEVVCIVGKGIWESIWRVRRGRGIRKEEFRYGWQDERENMGIVVADSASPTAWAGARVFVATSTSGLAATLRPAEKERIWKELGEWCERRRAERDTEAS

SEQ ID NO: 276 - protein, 397 aa, Pyronema omphalodes; identical to SEQ ID NO: 266

SEQ ID NO: 277 - DNA, 20 bp, Artificial sequence
  Synthetic oligonucleotide
gaatgtaaagcatagactgc

SEQ ID NO: 278 - DNA, 20 bp, Artificial sequence
  Synthetic oligonucleotide
gaatataaagcatagactgc

SEQ ID NO: 279 - DNA, 20 bp, Artificial sequence
  Synthetic oligonucleotide
gaacagaaagcatagactgc

SEQ ID NO: 280 - DNA, 20 bp, Artificial sequence
  Synthetic oligonucleotide
gaacgtaaagcatagactgc

SEQ ID NO: 281 - DNA, 20 bp, Artificial sequence
  Synthetic oligonucleotide
gaacataaagcatagactgc

SEQ ID NO: 282 - protein, 213 aa, Bacteriophage Mu
MKRTADGSEFESPKKKRKVAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISGGSKRTADGSEFEPKKKRKV

SEQ ID NO: 283 - protein, 194 aa, Bacteriophage Mu
MKRTADGSEFESPKKKRKVAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGISG

That which is claimed is:

1. A method of modifying a target nucleic acid, the method comprising:
   contacting the target nucleic acid with:
   a CRISPR-Cas effector protein,
   an adenine deaminase,
   an inosine glycosylase, wherein the inosine glycosylase is active, and
   a guide nucleic acid comprising a sequence that is complementary to the target nucleic acid,
   thereby modifying the target nucleic acid,
   wherein modifying the target nucleic acid comprises modifying an adenine (A) of the target nucleic acid to a cytosine (C), a thymine (T), or a guanine (G), and
   wherein the contacting comprises:
      contacting the target nucleic acid with a first fusion protein comprising the CRISPR-Cas effector protein, the adenine deaminase, and the inosine glycosylase, wherein the inosine glycosylase is fused to the C-terminus of the CRISPR-Cas effector protein, or
      contacting the target nucleic acid with a second fusion protein comprising the CRISPR-Cas effector protein and the adenine deaminase, wherein the inosine glycosylase is provided in trans, or
      recruiting the adenine deaminase to the CRISPR-Cas effector protein, wherein the inosine glycosylase is provided in trans.

2. The method of claim 1, wherein the modifying comprises modifying a first adenine (A) of the target nucleic acid to a cytosine (C) and a second adenine (A) of the target nucleic acid to a thymine (T).

3. The method of claim 1, wherein the modifying comprises modifying a first adenine (A) of the target nucleic acid to a cytosine (C) and a second adenine (A) of the target nucleic acid to a guanine (G).

4. The method of claim 1, wherein the modifying comprises modifying a first adenine (A) of the target nucleic acid to a thymine (T) and a second adenine (A) of the target nucleic acid to a guanine (G).

5. The method of claim 1, wherein the modifying comprises modifying a first adenine (A) of the target nucleic acid to a cytosine (C), a second adenine (A) of the target nucleic acid to a thymine (T), and a third adenine (A) of the target nucleic acid to a guanine (G).

6. The method of claim 1, wherein the contacting comprises contacting the target nucleic acid with the first fusion protein and wherein the adenine deaminase is linked to the inosine glycosylase via a peptide linker.

7. The method of claim 1, wherein the contacting comprises recruiting the CRISPR-Cas effector protein to the adenine deaminase, and wherein the inosine glycosylase is overexpressed in a cell in which it is present.

8. The method of claim 1, wherein the inosine glycosylase comprises an amino acid sequence having at least 70%, 75%, 80%, 85%, 90%, 95%, 96%, 97%, 98%, 99%, or more sequence identity to any one of SEQ ID NOs:79-91 or 146-276.

9. The method of claim 1, wherein the contacting comprises recruiting the CRISPR-Cas effector protein to the adenine deaminase, and wherein the inosine glycosylase is recruited to the target nucleic acid via the CRISPR-Cas effector protein and/or via the adenine deaminase.

10. The method of claim 1, wherein the inosine glycosylase comprises a peptide tag.

11. The method of claim 1, wherein the CRISPR-Cas effector protein, the adenine deaminase, and the guide nucleic acid form a complex or are comprised in a complex.

12. The method of claim 1, wherein the guide nucleic acid comprises a RNA recruiting motif.

13. The method of claim 1, wherein the inosine glycosylase and/or adenine deaminase comprise a MS2 capping protein (MCP) or a portion thereof.

14. The method of claim 1, wherein the contacting comprises recruiting the CRISPR-Cas effector protein to the adenine deaminase, and wherein the CRISPR-Cas effector protein and/or the adenine deaminase comprises a peptide tag;
  wherein the inosine glycosylase comprises an affinity polypeptide capable of binding the peptide tag;
  wherein the guide nucleic acid comprises a RNA recruiting motif; and
  wherein the peptide tag is recruited to the RNA recruiting motif and the inosine glycosylase is recruited to the peptide tag using the affinity polypeptide.

15. The method of claim 1, wherein the method is devoid of cleavage of the target nucleic acid and/or is devoid of nucleic acid cleavage.

16. The method of claim 1, wherein the adenine deaminase comprises all or a portion of an amino acid sequence of any one of SEQ ID NOs:50-60.

17. The method of claim 1, wherein the contacting comprises contacting the target nucleic acid with the first fusion protein and wherein the first fusion protein comprises from the N-terminus to the C-terminus, the adenine deaminase, the CRISPR-Cas effector protein, and the inosine glycosylase.

18. The method of claim 1, wherein the contacting comprises contacting the target nucleic acid with the second fusion protein and the inosine glycosylase that is provided in trans.

* * * * *